United States Patent 11,723,967 (ZIKA VIRUS VACCINE) - sequence listing, part 2

SEQ ID NO: 1515 - RNA, 2136 nt, Artificial Sequence
  KY272987.1 prME-long CDS opt
cgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccgacgucggcugcuccgucgacuucuccaag

SEQ ID NO: 1516 - RNA, 2136 nt, Artificial Sequence
  EU545988.1 prME-long CDS opt
cgcaucaucaacgcccgcaaggagaagaagcgccgcggcaccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaag

SEQ ID NO: 1517 - RNA, 2136 nt, Artificial Sequence
  KU681082.3 prME-long CDS opt
cgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaag

SEQ ID NO: 1518 - RNA, 2136 nt, Artificial Sequence
  KX601167.1 prME-long CDS opt
cgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaag

SEQ ID NO: 1519 - RNA, 2136 nt, Artificial Sequence
  KX694533.2 prME-long CDS opt
cgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaag

SEQ ID NO: 1520 - RNA, 2136 nt, Artificial Sequence
  KY288905.1 prME-long CDS opt
cgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1521 - RNA, 2136 nt, Artificial Sequence
  KF268950.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1522 - RNA, 2136 nt, Artificial Sequence
  KF383121.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1523 - RNA, 2118 nt, Artificial Sequence
  KF268949.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1524 - RNA, 2136 nt, Artificial Sequence
  KU955595.1 prME-long CDS opt
cgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1525 - RNA, 2136 nt, Artificial Sequence
  KF383116.1 prME-long CDS opt
cgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1526 - RNA, 2118 nt, Artificial Sequence
  KU963574.2 prME-long CDS opt
cgcaucaucaacgcccgcaaggagcgcaagcgccgcggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1527 - RNA, 2118 nt, Artificial Sequence
  KX601166.1 prME-long CDS opt
cgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1528 - RNA, 2136 nt, Artificial Sequence
  KF383118.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaag

SEQ ID NO: 1529 - RNA, 2130 nt, Artificial Sequence
  KF383120.1 prME-long CDS opt
cgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccgacgucggcugcuccgucgacuuc

SEQ ID NO: 1530 - RNA, 2061 nt, Artificial Sequence; identical to SEQ ID NO: 1365
  KU321639.1 prME-short CDS opt

SEQ ID NO: 1531 - RNA, 2061 nt, Artificial Sequence; identical to SEQ ID NO: 1366
  KU312312.1 prME-short CDS opt

SEQ ID NO: 1532 - RNA, 2049 nt, Artificial Sequence; identical to SEQ ID NO: 1367
  AY632535.2 prME-short CDS opt

SEQ ID NO: 1533 - RNA, 2061 nt, Artificial Sequence; identical to SEQ ID NO: 1368
  KU527068.1 prME-short CDS opt

SEQ ID NO: 1534 - RNA, 2061 nt, Artificial Sequence
  KX421193.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1535 - RNA, 2061 nt, Artificial Sequence
  KX377335.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1536 - RNA, 2061 nt, Artificial Sequence
  LC002520.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1537 - RNA, 2043 nt, Artificial Sequence
  DQ859059.1 prME-short CDS opt
accuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1538 - RNA, 2049 nt, Artificial Sequence
  KU963573.2 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1539 - RNA, 2061 nt, Artificial Sequence
  KX694534.2 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1540 - RNA, 2061 nt, Artificial Sequence
  KX369547.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1541 - RNA, 2061 nt, Artificial Sequence
  KX447515.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1542 - RNA, 2061 nt, Artificial Sequence
  KU729218.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1543 - RNA, 2061 nt, Artificial Sequence
  KU501217.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1544 - RNA, 2061 nt, Artificial Sequence
  KU312314.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1545 - RNA, 2061 nt, Artificial Sequence
  KX446950.2 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1546 - RNA, 2061 nt, Artificial Sequence
  KY003157.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgcc

SEQ ID NO: 1547 - RNA, 2061 nt, Artificial Sequence
  KX811222.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1548 - RNA, 2061 nt, Artificial Sequence
  KX447516.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1549 - RNA, 2061 nt, Artificial Sequence
  KX520666.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1550 - RNA, 2061 nt, Artificial Sequence
  KU497555.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1551 - RNA, 2061 nt, Artificial Sequence
  KY075939.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1552 - RNA, 2061 nt, Artificial Sequence
  KY075932.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1553 - RNA, 2061 nt, Artificial Sequence
  KU870645.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1554 - RNA, 2061 nt, Artificial Sequence
  KU729217.2 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1555 - RNA, 2061 nt, Artificial Sequence
  KX087101.3 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1556 - RNA, 2061 nt, Artificial Sequence
  KY014317.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1557 - RNA, 2061 nt, Artificial Sequence
  KU758876.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgcc

SEQ ID NO: 1558 - RNA, 2061 nt, Artificial Sequence
  KU758874.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1559 - RNA, 2061 nt, Artificial Sequence
  KY317939.1 prME-short CDS opt
accuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1560 - RNA, 2061 nt, Artificial Sequence
  KY014314.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1561 - RNA, 2061 nt, Artificial Sequence
  KX447517.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgcc

SEQ ID NO: 1562 - RNA, 2061 nt, Artificial Sequence
  KU926310.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1563 - RNA, 2061 nt, Artificial Sequence
  KU922923.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1564 - RNA, 2061 nt, Artificial Sequence
  KY075937.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1565 - RNA, 2061 nt, Artificial Sequence
  KY003156.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1566 - RNA, 2061 nt, Artificial Sequence
  KU312313.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 1567 - RNA, 2061 nt, Artificial Sequence
  KY075935.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1568 - RNA, 2061 nt, Artificial Sequence
  KY014320.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1569 - RNA, 2061 nt, Artificial Sequence
  KY328290.1 prME-short CDS opt
accuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1570 - RNA, 2061 nt, Artificial Sequence
  KU681081.3 prME-short CDS opt
accuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1571 - RNA, 2061 nt, Artificial Sequence
  KX827309.1 prME-short CDS opt
accuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1572 - RNA, 2061 nt, Artificial Sequence
  KU955593.1 prME-short CDS opt
accuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgcc

SEQ ID NO: 1573 - RNA, 2061 nt, Artificial Sequence
  KY272987.1 prME-short CDS opt
accuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgcc

SEQ ID NO: 1574 - RNA, 2061 nt, Artificial Sequence
  KY007221.1 prME-short CDS opt
accuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgcc

SEQ ID NO: 1575 - RNA, 2061 nt, Artificial Sequence
  EU545988.1 prME-short CDS opt
accuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgcc

SEQ ID NO: 1576 - RNA, 2061 nt, Artificial Sequence
  KU681082.3 prME-short CDS opt
accuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgcc

SEQ ID NO: 1577 - RNA, 2061 nt, Artificial Sequence
  KX601167.1 prME-short CDS opt
accuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgcc

SEQ ID NO: 1578 - RNA, 2061 nt, Artificial Sequence
  KX694533.2 prME-short CDS opt
accuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgcc

SEQ ID NO: 1579 - RNA, 2061 nt, Artificial Sequence
  KY288905.1 prME-short CDS opt
accuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1580 - RNA, 2061 nt, Artificial Sequence
  KF268950.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1581 - RNA, 2061 nt, Artificial Sequence
  KF383121.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1582 - RNA, 2043 nt, Artificial Sequence
  KF268949.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1583 - RNA, 2061 nt, Artificial Sequence
  KU955595.1 prME-short CDS opt
accuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1584 - RNA, 2061 nt, Artificial Sequence
  KF383116.1 prME-short CDS opt
accuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1585 - RNA, 2043 nt, Artificial Sequence
  KX601166.1 prME-short CDS opt
accuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1586 - RNA, 2061 nt, Artificial Sequence
  KF383118.1 prME-short CDS opt
accuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1587 - RNA, 2058 nt, Artificial Sequence
  KX447520.1 prME-short CDS opt
uccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1588 - RNA, 2061 nt, Artificial Sequence
  KU761561.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1589 - RNA, 2061 nt, Artificial Sequence
  KX806557.2 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1590 - RNA, 2061 nt, Artificial Sequence
  LC191864.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 1591 - RNA, 2061 nt, Artificial Sequence
  KU744693.1 prME-short CDS opt
accuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggc

SEQ ID NO: 1592 - RNA, 2052 nt, Artificial Sequence
  KU963574.2 prME-short CDS opt
ggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 1593 - RNA, 2070 nt, Artificial Sequence
  KF383120.1 prME-short CDS opt
ggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgcc

SEQ ID NO: 1594 - RNA, 1353 nt, Artificial Sequence; identical to SEQ ID NO: 1369
  KU321639.1 solE CDS opt

SEQ ID NO: 1595 - RNA, 1353 nt, Artificial Sequence; identical to SEQ ID NO: 1370
  KU312312.1 solE CDS opt

SEQ ID NO: 1596 - RNA, 1341 nt, Artificial Sequence; identical to SEQ ID NO: 1371
  AY632535.2 solE CDS opt

SEQ ID NO: 1597 - RNA, 1353 nt, Artificial Sequence; identical to SEQ ID NO: 1370
  KU527068.1 solE CDS opt

SEQ ID NO: 1598 - RNA, 1353 nt, Artificial Sequence
  KX421193.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1599 - RNA, 1353 nt, Artificial Sequence
  LC002520.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1600 - RNA, 1335 nt, Artificial Sequence
  DQ859059.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1601 - RNA, 1341 nt, Artificial Sequence
  KU963573.2 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1602 - RNA, 1353 nt, Artificial Sequence
  KY075939.1 solE CDS opt
ucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1603 - RNA, 1353 nt, Artificial Sequence
  KX447516.1 solE CDS opt
uccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1604 - RNA, 1353 nt, Artificial Sequence
  KX447515.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcucc

SEQ ID NO: 1605 - RNA, 1353 nt, Artificial Sequence
  KU758874.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1606 - RNA, 1353 nt, Artificial Sequence
  KU729218.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1607 - RNA, 1353 nt, Artificial Sequence
  KU501217.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1608 - RNA, 1353 nt, Artificial Sequence
  KU761561.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcucc

SEQ ID NO: 1609 - RNA, 1353 nt, Artificial Sequence
  KY075937.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1610 - RNA, 1353 nt, Artificial Sequence
  KY014317.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1611 - RNA, 1353 nt, Artificial Sequence
  KU870645.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1612 - RNA, 1353 nt, Artificial Sequence
  KU922923.1 solE CDS opt
ucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1613 - RNA, 1353 nt, Artificial Sequence
  KU497555.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1614 - RNA, 1353 nt, Artificial Sequence
  KU312314.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1615 - RNA, 1353 nt, Artificial Sequence
  KY014314.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1616 - RNA, 1353 nt, Artificial Sequence
  KX447517.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1617 - RNA, 1353 nt, Artificial Sequence
  KU729217.2 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1618 - RNA, 1353 nt, Artificial Sequence
  KY328290.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1619 - RNA, 1353 nt, Artificial Sequence
  KX087101.3 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1620 - RNA, 1353 nt, Artificial Sequence
  KY003156.1 solE CDS opt
ucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1621 - RNA, 1353 nt, Artificial Sequence
  KU758876.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1622 - RNA, 1353 nt, Artificial Sequence
  KU926310.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1623 - RNA, 1353 nt, Artificial Sequence
  KU681081.3 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1624 - RNA, 1353 nt, Artificial Sequence
  KU744693.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1625 - RNA, 1353 nt, Artificial Sequence
  EU545988.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1626 - RNA, 1353 nt, Artificial Sequence
  KY007221.1 solE CDS opt
ucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1627 - RNA, 1353 nt, Artificial Sequence
  KY003152.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcgccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1628 - RNA, 1353 nt, Artificial Sequence
  KX694533.2 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1629 - RNA, 1353 nt, Artificial Sequence
  KX601167.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcucc

SEQ ID NO: 1630 - RNA, 1353 nt, Artificial Sequence
  KY288905.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1631 - RNA, 1353 nt, Artificial Sequence
  KF268950.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1632 - RNA, 1353 nt, Artificial Sequence
  KF383116.1 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1633 - RNA, 1335 nt, Artificial Sequence
  KU963574.2 solE CDS opt
ucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcucc

SEQ ID NO: 1634 - RNA, 1353 nt, Artificial Sequence
  KF383118.1 solE CDS opt
ucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1635 - RNA, 1353 nt, Artificial Sequence
  KX520666.1 solE CDS opt
cgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1636 - RNA, 1353 nt, Artificial Sequence
  KF383120.1 solE CDS opt
ucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcucc

SEQ ID NO: 1637 - RNA, 2136 nt, Artificial Sequence
  ZIKV (strain ZikaSPH2015) Polyprotein(93-804) CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaa

SEQ ID NO: 1638 - RNA, 2136 nt, Artificial Sequence
  ZIKV (isolate Z1106033) Polyprotein(93-804) CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaaugcaaagaacgguagcauauccuugaugugucucgccuuagggggaguucugaucuuccugucaacggcugucagugccgacgugggcugcucuguggauuuuagcaaa

SEQ ID NO: 1639 - RNA, 2124 nt, Artificial Sequence
  ZIKV (strain MR 766) Polyprotein(93-800) CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugaggaccgagcaaaggucgaggugacaccuaauucaccacgcgcugaagccacucuugggggauucggcagucuggguuuggauugugagcccagaaccgggcucgacuuuagcgaucuguauuacuuaacaaugaacaauaaacacuggcugguacauaaggaaugguuccacgacauaccucucccauggcacgcuggcgccgauacuggaaccccgcauuggaacaauaaagaggcacuuguugaauuuaaggacgcccacgcuaagaggcagacaguggucgugcugggcucccaggagggggcgguccauaccgcauuggccggagcucuagaggccgaaauggauggugcaaaaggccggcuguucucugggcaccucaagugccgccugaaaauggacaaacuuagacugaagggagugagcuauucauuguguacugccgcuuuuacguucacaaagguucccgccgagacccuccauggcacugugaccguagaaguccaguacgcagguacagacgggccuugcaagaucccagugcaaauggcgguugauaugcagacccugacucccgugggcagguuaauuacagcuaacccugucaucacggagaguaccgaaaauuccaaaaugaugcuggagcuagacccacccuuuggagauagcuacauagugauuggcguaggggacaagaaaaucacucaccacuggcaucguucuggaucaacaaucgguaaggccuucgaggcaaccgugcggggcgccaaacgaauggcuguucucggggauacagccugggacuucggaagugucggcgguguguuuaacagccuggggaagggcauucaccagaucuucggagcagcuuuuaagucccuuuucggcgggaugucuugguuuucgcaaauuuugauaggaacucugcucguguggcugggccuuaacaccaaaaaugguagcaucucccugacguguuuggcccucgggggagucaugauuuuccugucaaccgcgguuagugccgaugugggcugcucuguggacuuuagcaag

SEQ ID NO: 1640 - RNA, 2136 nt, Artificial Sequence
  ZIKV (strain NatalRGN) Polyprotein(93-804) CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaa

SEQ ID NO: 1641 - RNA, 2061 nt, Artificial Sequence
  ZIKV (strain ZikaSPH2015) Polyprotein(108-794) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugca

SEQ ID NO: 1642 - RNA, 2061 nt, Artificial Sequence
  ZIKV (isolate Z1106033) Polyprotein(108-794) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacgccaagaauggcagcaucuccuugaugugucucgcucugggugggguuuuaauuuuccugucaacggcagucagugcc

SEQ ID NO: 1643 - RNA, 2049 nt, Artificial Sequence
  ZIKV (strain MR 766) Polyprotein(108-790) CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacaauuggaaaggcguucgaggcuaccgugcggggugccaaacgcauggcaguucucggcgacacagccugggauuucgggagugucggaggcguguuuaauagccuggguaaggggauccaccagaucuucggcgcugccuuuaaaucccuuuucggaggcaugucuugguuuucgcaaauuuugaucgggacucugcucguguggcugggacuuaacaccaagaacggcagcauuucccugacguguuuggcacucgguggggucaugauauuccugucaaccgcuguuagugcc

SEQ ID NO: 1644 - RNA, 2061 nt, Artificial Sequence
  ZIKV (strain NatalRGN) Polyprotein(108-794) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugca

SEQ ID NO: 1645 - RNA, 1353 nt, Artificial Sequence
  ZIKV (strain ZikaSPH2015) Polyprotein(273-723) CDS opt
agccagaaggugaucuaccuggucaugauucuccuuauagcccccgcuuauuccaucagaugcauuggcguuucuaacagggacuucguggaggggaugucaggagguaccuggguagauaucgugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggauca

SEQ ID NO: 1646 - RNA, 1353 nt, Artificial Sequence
  ZIKV (isolate Z1106033) Polyprotein(273-723) CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgaaacggauggcaguucugggggacacagccugggauuuuggauca

SEQ ID NO: 1647 - RNA, 1341 nt, Artificial Sequence
  ZIKV (strain MR 766) Polyprotein(273-719) CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugaggacagggccaagguggaagucacgcccaacaguccucgggcugaggcaacucugggaggguuuggcagcuugggucucgauugcgagccacgcaccgggcuggacuucucugaucuguacuaccucacaaugaauaacaaacauugguuaguucacaaggaaugguuucaugacauuccccugccuuggcacgccggagcugacacuggcaccccacacuggaauaacaaagaggcccuuguggaguucaaggaugcgcaugcaaagagacagacaguaguggucuugggcucccaggaaggggccgugcacaccgcucuggccggagcacuagaagcugagauggacggugccaaaggcaggcucuuuucagggcaucugaagugucggcuuaaaauggauaagcugcgcuugaaaggaguuagcuauagucucugcacggcggccuucacuuuuacaaaggugcccgcagagacccugcacggcacugucacaguggaaguacaauacgcugguaccgacgggccuuguaaaaucccaguucagauggccguggauaugcagacguuaaccccggucggccgacugauuacagcuaaucccgugaucacugagucuaccgaaaacuccaagaugaugcucgagcuugacccuccauucggagauagcuauauagucauuggcgugggggacaagaaaaucacacaccauuggcacagaucgggaucuacuauugguaaggccuuugaagcaaccguuaggggcgccaaacggauggcugugcugggggauacagcgugggacuucggaucc

SEQ ID NO: 1648 - RNA, 1353 nt, Artificial Sequence; identical to SEQ ID NO: 1646
  ZIKV (strain NatalRGN) Polyprotein(273-723) CDS opt

SEQ ID NO: 1649 - RNA, 2061 nt, Artificial Sequence
  ZIKV (strain ZikaSPH2015) Polyprotein(108-794)(F398S) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcugaguggaaagggcucucuagucacaugcgcgaaauucgccugcuccaagaaaaugaccggcaagagcauucagccugaaaaccucgaguaccguaucaugcugucggugcacgggucucaacacuccggaaugauuguuaaugacacgggucaugaaaccgaugagaaccgcgcaaagguggagaucacaccaaauucacccagagcugaagccacucuuggcggguuuggaagucugggcuuggacugugagccuaggaccggucucgauuucagcgaccuguauuacuuaacaaugaacaauaaacacuggcugguccauaaggaaugguuucacgauaucccacucccguggcacgcuggggccgacacuggcaccccucauuggaacaauaaagaggcacuuguggaguucaaggaugcccacgcuaaacggcagacaguaguugugcugggaucccaggaaggcgcgguccauaccgcauuggccggggcucuagaggccgaaauggacggagcaaagggucgacugucuagcggccaccucaaaugccgccugaagauggauaagcugagacugaaaggggugucauauaguuuguguacugccgcuuuuacguucacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggaguccaccgaaaacagcaagaugaugcuggagcuagaucccccguuuggcgacucuuacauuguuaucggagugggcgagaaaaagauaacucaccacuggcaucggucagggaguacaauuggaaaggcauucgaagccaccguccgcggugcuaaaagaauggccgugcucggcgauacagcaugggacuuugggagcguaggaggcgcucuuaauucccuugguaaggggauccaccagaucuucggcgccgcguucaaaucuuuguuuggaggcaugucgugguucagccaaauucugaucgggacucuccugauguggcuuggacugaacaccaagaauggcuccauuucauugaugugucucgcccugggugggguguuaauauuucugaguacggcuguuucugca

SEQ ID NO: 1650 - RNA, 2061 nt, Artificial Sequence
  ZIKV (isolate Z1106033) Polyprotein(108-794)(F398S) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcugaguggaaagggcucucuagugaccugcgcgaaauucgccugcuccaagaaaaugacgggcaagagcauacagccugaaaaccucgaguaccguauuaugcugucgguucacgggucucaacacuccggaaugaucgugaaugacaccggucaugaaacagaugagaaccgcgcaaaggucgagauuacuccaaauucacccagagcugaagccacccuuggcggguuuggaagucugggcuuggacugugagccuaggacaggucucgauuucagcgaccuguauuacuuaacuaugaacaauaaacacuggcuggugcauaaggaaugguuucacgauaucccacucccguggcacgcuggggccgacaccggcacaccccauuggaacaauaaagaggcacuuguagaguucaaggaugcccacgcuaaacggcagaccguugugguccugggaucccaggaaggcgcggugcauacugcauuggccggggcucuagaggccgaaauggacggagcaaagggucgacugucuagcggccaccucaaaugccgccugaagauggauaagcugagacugaaaggggucucauauaguuuguguacggccgcuuuuacauucaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgaguccacugaaaacagcaagaugaugcuggagcuagaucccccguuuggcgacucuuacaucgugauuggagucggcgagaaaaagaucacacaccacuggcaucggucagggaguaccauaggaaaggcauucgaagccacagugcgcggugcuaaaagaauggccguacucggcgauacugcaugggacuuugggagcgugggaggcgcucuuaauucccuugguaaggggauucaccagaucuucggcgccgcguucaaaucuuuguuuggaggcaugucgugguucagccaaauccugauugggacccuccugauguggcuuggacugaacgccaagaauggcuccaucucauugaugugucucgcucugggugggguuuuaauuuuucugaguacggcagucucugcc

SEQ ID NO: 1651 - RNA, 2049 nt, Artificial Sequence
  ZIKV (strain MR 766) Polyprotein(108-790)(F398S) CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcugucuggaaagggcucccuaguuacaugcgccaaauuuaccugcagcaagaagaugacgggcaaaucgauccagcccgaaaaucucgaauaucggauuaugcugucugugcacgggucccaacauucaggaaugaucgguuacgagaccgacgaagaucgugcgaaggucgaggugacaccuaacaguccacgcgccgaggcaacucuuggcggguucggaagccugggcuuggacugugaacccagaaccggucucgauuucuccgaccuguauuacuuaacaaugaauaacaaacacuggcugguacauaaggagugguuucacgauaucccucucccauggcacgcuggggccgacacuggcaccccgcauuggaauaacaaagaagcucuuguugaguucaaggaugcccacgcaaaaaggcagacaguggucgugcugggaucucaggaaggcgccguccauaccgcuuuggcgggggcacuagaggccgagauggacggagcuaagggucggcuguuuagcggccaccucaagugccgacugaaaauggauaaacuucgccugaagggggugucauauaguuuguguacugccgcauucacguuuacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaauccaccgagaacagcaagaugaugcuggaacuagauccacccuucggcgacucuuacauugugaucggaguaggcgauaagaaaauaacucaccacuggcauaggucagggaguacaauuggaaaggcguuugaggcuaccgugcggggugccaaacgcauggcaguucucggcgacacagccugggauuucgggagcgucggaggcguguucaauucccuggguaaggggauccaccagaucuuuggcgcugccuucaaaucucuuuuuggaggcaugucgugguucagccaaauuuugaucgggacucugcucguguggcugggacuuaacaccaagaacggcuccauuucacugacguguuuggcacucgguggggucaugauauuucugaguaccgcuguuucugcc

SEQ ID NO: 1652 - RNA, 2061 nt, Artificial Sequence
  ZIKV (strain NatalRGN) Polyprotein(108-794)(F398S) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcugaguggaaagggcucucuagugacaugcgcgaaauucgccugcuccaagaaaaugaccggcaagagcauacagccugaaaaccucgaguaccguauuaugcugucgguucacgggucucaacacuccggaaugaucgugaaugacacgggucaugaaaccgaugagaaccgcgcaaaggucgagauuacaccaaauucacccagagcugaagccacucuuggcggguuuggaagucugggcuuggacugugagccuaggaccggucucgauuucagcgaccuguauuacuuaacaaugaacaauaaacacuggcuggugcauaaggaaugguuucacgauaucccacucccguggcacgcuggggccgacacuggcaccccucauuggaacaauaaagaggcacuuguagaguucaaggaugcccacgcuaaacggcagacaguugugguccugggaucccaggaaggcgcggugcauaccgcauuggccggggcucuagaggccgaaauggacggagcaaagggucgacugucuagcggccaccucaaaugccgccugaagauggauaagcugagacugaaaggggucucauauaguuuguguacugccgcuuuuacguucacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggaguccaccgaaaacagcaagaugaugcuggagcuagaucccccguuuggcgacucuuacaucgugauuggagucggcgagaaaaagaucacucaccacuggcaucggucagggaguacaauaggaaaggcauucgaagccaccgugcgcggugcuaaaagaauggccguacucggcgauacagcaugggacuuugggagcgugggaggcgcucuuaauucccuugguaaggggauucaccagaucuucggcgccgcguucaaaucuuuguuuggaggcaugucgugguucagccaaauccugauugggacucuccugauguggcuuggacugaacaccaagaauggcuccaucucauugaugugucucgcccugggugggguuuuaauuuuucugaguacggcugucucugca

SEQ ID NO: 1653 - RNA, 2061 nt, Artificial Sequence
  ZIKV (strain ZikaSPH2015) Polyprotein(108-794)(N444Q) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguucaggacacgggucaugaaaccgaugagaaucgcgcaaagguggagaucacaccaaacucccccagagcugaagccacucuuggcggguucggaucacugggcuuggacugugagccuaggaccggucucgauuuuagugaccuguauuacuuaacaaugaauaacaaacacuggcugguccauaaggaaugguuccacgauaucccacucccguggcacgcuggggccgacacuggcaccccucauuggaauaacaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaauacgcaggcacagacgguccaugcaaagugcccgcgcagauggcuguagacaugcagacccugacuccugucgggagguuaauaacagccaauccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaacagccuugguaaggggauccaccaaaucuucggcgccgcguuuaaauccuuguucggaggcaugucuugguuuucgcagauucugaucgggacucuccugauguggcuuggacugaauaccaagaacggcagcauuuccuugaugugucucgcccugggugggguguuaauauuccugucaacggcuguuagugca

SEQ ID NO: 1654 - RNA, 2061 nt, Artificial Sequence
  ZIKV (isolate Z1106033) Polyprotein(108-794)(N444Q) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugcaggacaccggucaugaaacagaugagaaucgcgcaaaggucgagauuacuccaaacucccccagagcugaagccacccuuggcggguucggaucacugggcuuggacugugagccuaggacaggucucgauuuuagugaccuguauuacuuaacuaugaauaacaaacacuggcuggugcauaaggaaugguuccacgauaucccacucccguggcacgcuggggccgacaccggcacaccccauuggaauaacaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaauacgcaggcaccgacgguccaugcaaaguacccgcgcagauggcugucgacaugcagacucugacaccuguggggagguuaauuacggccaauccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaacagccuugguaaggggauucaccaaaucuucggcgccgcguuuaaauccuuguucggaggcaugucuugguuuucgcagauccugauugggacccuccugauguggcuuggacugaaugccaagaacggcagcaucuccuugaugugucucgcucugggugggguuuuaauuuuccugucaacggcagucagugcc

SEQ ID NO: 1655 - RNA, 2061 nt, Artificial Sequence
  ZIKV (strain NatalRGN) Polyprotein(108-794)(N444Q) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugcaggacacgggucaugaaaccgaugagaaucgcgcaaaggucgagauuacaccaaacucccccagagcugaagccacucuuggcggguucggaucacugggcuuggacugugagccuaggaccggucucgauuuuagugaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagguuaauuacagccaauccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaacagccuugguaaggggauucaccaaaucuucggcgccgcguuuaaauccuuguucggaggcaugucuugguuuucgcagauccugauugggacucuccugauguggcuuggacugaauaccaagaacggcagcaucuccuugaugugucucgcccugggugggguuuuaauuuuccugucaacggcugucagugca

SEQ ID NO: 1656 - RNA, 2061 nt, Artificial Sequence
  ZIKV (strain ZikaSPH2015) Polyprotein(108-694)-Cterm-JAEV1-E(400-500) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacacucggaaaggcauuuaguaccacacugaaaggugcccagcgccuugcugccuugggcgauacugcaugggacuucgggagcauuggaggcgucuucaauuccaucgguagagcugugcaccaaguauuugggggcgccuucaggacccuguuuggaggcaugucuuggaucacgcaggggcucaugggagcgcugcuucuguggaugggcgugaacgcccgugaucggucgauugcuuuggcauuccucgccaccggugggguucuggucuuuuuagcuacaaaugugcaugcc

SEQ ID NO: 1657 - RNA, 2061 nt, Artificial Sequence
  ZIKV (isolate Z1106033) Polyprotein(108-694)-Cterm-JAEV1-E(400-500) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaacccucggaaaggcauuuaguacaacucugaaaggugcccagcgccuugcugccuugggcgauaccgcaugggacuucgggagcauaggaggcguguucaauuccauugguagagcuguacaccaaguguuugggggcgccuucaggacgcuguuuggaggcaugucuuggaucacccaggggcucaugggagcgcugcuucuguggaugggcguuaacgcccgugaucggucgaucgcuuuggcauuccucgccacaggugggguccugguguuuuuagcuacuaaugugcaugcc

SEQ ID NO: 1658 - RNA, 2049 nt, Artificial Sequence
  ZIKV (strain MR 766) Polyprotein(108-690)-Cterm-JAEV1-E(400-500) CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacacucggaaaggcguucaguaccacacugaaaggugcucagcggcuugccgcauugggcgacacugccugggauuucgggagcauuggaggcguguuuaauuccaucggucgcgcuguucaccaagucuucgggggcgccuuuagaacccuguucggaggcaugucuuggaucacgcaggggcucaugggagcacugcuucuguggaugggcgugaacgcuagggaccguucgauugccuuggcguuucucgccaccgguggggugcuggucuucuuagcuacaaacguucaugca

SEQ ID NO: 1659 - RNA, 2061 nt, Artificial Sequence
  ZIKV (strain NatalRGN) Polyprotein(108-694)-Cterm-JAEV1-E(400-500) CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacacucggaaaggcauuuaguaccacacugaaaggugcccagcgccuugcugccuugggcgauacugcaugggacuucgggagcauaggaggcguguucaauuccauugguagagcuguacaccaaguguuugggggcgccuucaggacccuguuuggaggcaugucuuggaucacgcaggggcucaugggagcgcugcuucuguggaugggcguuaacgcccgugaucggucgaucgcuuuggcauuccucgccaccggugggguccugguguuuuuagcuacaaaugugcaugcc

SEQ ID NO: 1660 - RNA, 2136 nt, Artificial Sequence; identical to SEQ ID NO: 1637
  ZIKV (strain ZikaSPH2015) Polyprotein(93-804) CDS opt

SEQ ID NO: 1661 - RNA, 2133 nt, Artificial Sequence
  ZIKV prME variant CDS opt
aucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaa

SEQ ID NO: 1662 - RNA, 2130 nt, Artificial Sequence
  ZIKV prME variant CDS opt
aucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcucuguggauuuuagcaaa

SEQ ID NO: 1663 - RNA, 2127 nt, Artificial Sequence
  ZIKV prME variant CDS opt
aacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcucuguggauuuuagcaaa

SEQ ID NO: 1664 - RNA, 2124 nt, Artificial Sequence
  ZIKV prME variant CDS opt
gccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcucuguggauuuuagcaaa

SEQ ID NO: 1665 - RNA, 2121 nt, Artificial Sequence
  ZIKV prME variant CDS opt
agaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaa

SEQ ID NO: 1666 - RNA, 2118 nt, Artificial Sequence
  ZIKV prME variant CDS opt
aaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaa

SEQ ID NO: 1667 - RNA, 2115 nt, Artificial Sequence
  ZIKV prME variant CDS opt
gagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaag

SEQ ID NO: 1668 - RNA, 2112 nt, Artificial Sequence
  ZIKV prME variant CDS opt
aagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaag

SEQ ID NO: 1669 - RNA, 2109 nt, Artificial Sequence
  ZIKV prME variant CDS opt
aagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcucuguggauuuuagcaag

SEQ ID NO: 1670 - RNA, 2106 nt, Artificial Sequence
  ZIKV prME variant CDS opt
agaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaa

SEQ ID NO: 1671 - RNA, 2103 nt, Artificial Sequence
  ZIKV prME variant CDS opt
agaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaa

SEQ ID NO: 1672 - RNA, 2100 nt, Artificial Sequence
  ZIKV prME variant CDS opt
ggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaa

SEQ ID NO: 1673 - RNA, 2097 nt, Artificial Sequence
  ZIKV prME variant CDS opt
gccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcucuguggauuuuagcaaa

SEQ ID NO: 1674 - RNA, 2094 nt, Artificial Sequence
  ZIKV prME variant CDS opt
gacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcucuguggauuuuagcaaa

SEQ ID NO: 1675 - RNA, 2091 nt, Artificial Sequence
  ZIKV prME variant CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcucuguggacuuuagcaaa

SEQ ID NO: 1676 - RNA, 2091 nt, Artificial Sequence
  ZIKV prME variant CDS opt
accagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcucuguggacuuuagcaaa

SEQ ID NO: 1677 - RNA, 2103 nt, Artificial Sequence
  ZIKV prME variant CDS opt
agaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcucuguggauuuuagcaaa

SEQ ID NO: 1678 - RNA, 2127 nt, Artificial Sequence
  ZIKV prME variant CDS opt
agaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcuccguggauuucucaaag

SEQ ID NO: 1679 - RNA, 2127 nt, Artificial Sequence
  ZIKV prME variant CDS opt
agaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcuccguggauuucucaaag

SEQ ID NO: 1680 - RNA, 2118 nt, Artificial Sequence
  ZIKV prME variant CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugc

SEQ ID NO: 1681 - RNA, 2115 nt, Artificial Sequence
  ZIKV prME variant CDS opt
aucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugc

SEQ ID NO: 1682 - RNA, 2112 nt, Artificial Sequence
  ZIKV prME variant CDS opt
aucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugc

SEQ ID NO: 1683 - RNA, 2109 nt, Artificial Sequence
  ZIKV prME variant CDS opt
aacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugc

SEQ ID NO: 1684 - RNA, 2106 nt, Artificial Sequence
  ZIKV prME variant CDS opt
gccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugc

SEQ ID NO: 1685 - RNA, 2103 nt, Artificial Sequence
  ZIKV prME variant CDS opt
agaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugc

SEQ ID NO: 1686 - RNA, 2100 nt, Artificial Sequence
  ZIKV prME variant CDS opt
aaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugc

SEQ ID NO: 1687 - RNA, 2097 nt, Artificial Sequence
  ZIKV prME variant CDS opt
gagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugc

SEQ ID NO: 1688 - RNA, 2094 nt, Artificial Sequence
  ZIKV prME variant CDS opt
aagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugc

SEQ ID NO: 1689 - RNA, 2091 nt, Artificial Sequence
  ZIKV prME variant CDS opt
aagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugc

SEQ ID NO: 1690 - RNA, 2088 nt, Artificial Sequence
  ZIKV prME variant CDS opt
agaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugc

SEQ ID NO: 1691 - RNA, 2085 nt, Artificial Sequence
  ZIKV prME variant CDS opt
agaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugc

SEQ ID NO: 1692 - RNA, 2082 nt, Artificial Sequence
  ZIKV prME variant CDS opt
ggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugc

SEQ ID NO: 1693 - RNA, 2079 nt, Artificial Sequence
  ZIKV prME variant CDS opt
gccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugc

SEQ ID NO: 1694 - RNA, 2076 nt, Artificial Sequence
  ZIKV prME variant CDS opt
gacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugc

SEQ ID NO: 1695 - RNA, 2073 nt, Artificial Sequence
  ZIKV prME variant CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugc

SEQ ID NO: 1696 - RNA, 2073 nt, Artificial Sequence
  ZIKV prME variant CDS opt
accagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugc

SEQ ID NO: 1697 - RNA, 2085 nt, Artificial Sequence
  ZIKV prME variant CDS opt
agaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugc

SEQ ID NO: 1698 - RNA, 2109 nt, Artificial Sequence
  ZIKV prME variant CDS opt
agaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugc

SEQ ID NO: 1699 - RNA, 2109 nt, Artificial Sequence
  ZIKV prME variant CDS opt
agaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugc

SEQ ID NO: 1700 - RNA, 2109 nt, Artificial Sequence
  ZIKV prME variant CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugac

SEQ ID NO: 1701 - RNA, 2106 nt, Artificial Sequence
  ZIKV prME variant CDS opt
aucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugac

SEQ ID NO: 1702 - RNA, 2103 nt, Artificial Sequence
  ZIKV prME variant CDS opt
aucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugac

SEQ ID NO: 1703 - RNA, 2100 nt, Artificial Sequence
  ZIKV prME variant CDS opt
aacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugac

SEQ ID NO: 1704 - RNA, 2097 nt, Artificial Sequence
  ZIKV prME variant CDS opt
gccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugac

SEQ ID NO: 1705 - RNA, 2094 nt, Artificial Sequence
  ZIKV prME variant CDS opt
agaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgac

SEQ ID NO: 1706 - RNA, 2091 nt, Artificial Sequence
  ZIKV prME variant CDS opt
aaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgac

SEQ ID NO: 1707 - RNA, 2088 nt, Artificial Sequence
  ZIKV prME variant CDS opt
gagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgac

SEQ ID NO: 1708 - RNA, 2085 nt, Artificial Sequence
  ZIKV prME variant CDS opt
aagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgac

SEQ ID NO: 1709 - RNA, 2082 nt, Artificial Sequence
  ZIKV prME variant CDS opt
aagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgac

SEQ ID NO: 1710 - RNA, 2079 nt, Artificial Sequence
  ZIKV prME variant CDS opt
agaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgac

SEQ ID NO: 1711 - RNA, 2076 nt, Artificial Sequence
  ZIKV prME variant CDS opt
agaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgac

SEQ ID NO: 1712 - RNA, 2073 nt, Artificial Sequence
  ZIKV prME variant CDS opt
ggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgac

SEQ ID NO: 1713 - RNA, 2070 nt, Artificial Sequence
  ZIKV prME variant CDS opt
gccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgac

SEQ ID NO: 1714 - RNA, 2067 nt, Artificial Sequence
  ZIKV prME variant CDS opt
gacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagac

SEQ ID NO: 1715 - RNA, 2064 nt, Artificial Sequence
  ZIKV prME variant CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagau

SEQ ID NO: 1716 - RNA, 2064 nt, Artificial Sequence
  ZIKV prME variant CDS opt
accagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgau

SEQ ID NO: 1717 - RNA, 2076 nt, Artificial Sequence
  ZIKV prME variant CDS opt
agaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugac

SEQ ID NO: 1718 - RNA, 2100 nt, Artificial Sequence
  ZIKV prME variant CDS opt
agaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggac

SEQ ID NO: 1719 - RNA, 2100 nt, Artificial Sequence
  ZIKV prME variant CDS opt
agaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgac

SEQ ID NO: 1720 - RNA, 2106 nt, Artificial Sequence
  ZIKV prME variant CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcu

SEQ ID NO: 1721 - RNA, 2100 nt, Artificial Sequence
  ZIKV prME variant CDS opt
aucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcu

SEQ ID NO: 1722 - RNA, 2103 nt, Artificial Sequence
  ZIKV prME variant CDS opt
aucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcu

SEQ ID NO: 1723 - RNA, 2097 nt, Artificial Sequence
  ZIKV prME variant CDS opt
aacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcu

SEQ ID NO: 1724 - RNA, 2094 nt, Artificial Sequence
  ZIKV prME variant CDS opt
gccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcu

SEQ ID NO: 1725 - RNA, 2091 nt, Artificial Sequence
  ZIKV prME variant CDS opt
agaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugcc

SEQ ID NO: 1726 - RNA, 2088 nt, Artificial Sequence
  ZIKV prME variant CDS opt
aaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugcc

SEQ ID NO: 1727 - RNA, 2085 nt, Artificial Sequence
  ZIKV prME variant CDS opt
gagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugcc

SEQ ID NO: 1728 - RNA, 2082 nt, Artificial Sequence
  ZIKV prME variant CDS opt
aagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugcc

SEQ ID NO: 1729 - RNA, 2079 nt, Artificial Sequence
  ZIKV prME variant CDS opt
aagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugcc

SEQ ID NO: 1730 - RNA, 2076 nt, Artificial Sequence
  ZIKV prME variant CDS opt
agaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugcc

SEQ ID NO: 1731 - RNA, 2073 nt, Artificial Sequence
  ZIKV prME variant CDS opt
agaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugcc

SEQ ID NO: 1732 - RNA, 2070 nt, Artificial Sequence
  ZIKV prME variant CDS opt
ggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugcc

SEQ ID NO: 1733 - RNA, 2067 nt, Artificial Sequence
  ZIKV prME variant CDS opt
gccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugcc

SEQ ID NO: 1734 - RNA, 2064 nt, Artificial Sequence
  ZIKV prME variant CDS opt
gacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugca

SEQ ID NO: 1735 - RNA, 2061 nt, Artificial Sequence; identical to SEQ ID NO: 1641
  ZIKV (strain ZikaSPH2015) Polyprotein(108-794) CDS opt

SEQ ID NO: 1736 - RNA, 2061 nt, Artificial Sequence
  ZIKV prME variant CDS opt
accagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugcc

SEQ ID NO: 1737 - RNA, 2073 nt, Artificial Sequence
  ZIKV prME variant CDS opt
agaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcu

SEQ ID NO: 1738 - RNA, 2097 nt, Artificial Sequence
  ZIKV prME variant CDS opt
agaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcg

SEQ ID NO: 1739 - RNA, 2097 nt, Artificial Sequence
  ZIKV prME variant CDS opt
agaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgcc

SEQ ID NO: 1740 - RNA, 2136 nt, Artificial Sequence; identical to SEQ ID NO: 1637
  KU321639.1 prME-long CDS opt

SEQ ID NO: 1741 - RNA, 2136 nt, Artificial Sequence; identical to SEQ ID NO: 1638
  KU312312.1 prME-long CDS opt

SEQ ID NO: 1742 - RNA, 2124 nt, Artificial Sequence; identical to SEQ ID NO: 1639
  AY632535.2 prME-long CDS opt

SEQ ID NO: 1743 - RNA, 2136 nt, Artificial Sequence; identical to SEQ ID NO: 1640
  KU527068.1 prME-long CDS opt

SEQ ID NO: 1744 - RNA, 2136 nt, Artificial Sequence
  KU720415.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauaccggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaa

SEQ ID NO: 1745 - RNA, 2118 nt, Artificial Sequence
  DQ859059.1 prME-long CDS opt
agaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugaugaaaaccgagccaagguagagguuacaccuaauucaccacgcgcagaggcuacucuuggcggguucggaagucugggcuuggacugugaacccagaaccggucucgauuuuagcgaccuguacuauuuaacaaugaacaauaaacacuggcuggugcauaaggagugguuccacgauauuccucucccauggcacgccggggcugacacuggcaccccgcauuggaacaauaaagaagcccuugucgaguuuaaggaugcacacgccaagaggcagacaguggucgugcugggaucccaggaaggcgcuguucauaccgcguuggcaggggcccuagaggcugagauggacggagccaaaggucggcuguucucuggccaccucaagugccgccugaaaauggauaaacuuagacugaagggggugagcuacucauuguguacugcagccuuuacguucacaaagguacccgcugaaacccuccauggaacugucaccguggagguucaguaugccggcacagacgguccuugcaaggugccagcacaaauggcggucgacaugcagacccugacucccguggggagguuaauaacagcuaacccuguaaucacggaaaguaccgagaacuccaaaaugaugcuggaacuagauccacccuuuggcgacagcuacauugugaucggaguuggcgauaagaaaauaacucaccacuggcaucguucugggucaacaauuggaaaggccuucgaggcaaccguccggggugccaaacgaauggcugugcucggcgacacagccugggauuucgggagugugggaggcgucuuuaauagccuggguaaggggauccaccagaucuucggcgcagcuuuuaagucccuuuucggaggcaugucuugguuuucgcaaauuuugaucgggacucugcucguuuggcugggacuuaacaccaaaaauggcagcauuucccugacguguuuggcccucgguggggugaugauauuccugucaaccgcggugagugccgacguaggaugcucugucgauuuuagcaag

SEQ ID NO: 1746 - RNA, 2136 nt, Artificial Sequence
  KX377335.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccggaagaaaggggaagcacgcagauccaggcgggccgucacacuaccaucucauucgacccgcaagcuccaaacgcgaucacagacuuggcuggagagcagagaguauaccaagcaccuuauaaaaguggaaaauuggaucuuuaggaacccgggauucgcucugguugccguggcgauugcaugguugcucggcaguuccacaucucagaaggucaucuaccuggugaugauucugcucaucgcccccgcuuauagcauacggugcauuggcguauccaaucgugauuuuguugaggggaugucaggagguacuuggguggacgucguguuagaacauggcgggugugugaccgucauggcccaggauaaaccuacaguugacaucgagcuggugaccacgacuguaaguaacauggcagaggugcgcagcuacugcuacgaggcuucuauuuccgauauggccucagacagcagauguccaacacaaggagaagcguaucuugacaagcagagugauacccaguacgucugcaaaaggacuuugguggaccggggcugggguaauggguguggacuguucggcaagggcucucuaguuacaugcgccaaguuuaccugcuccaaaaagaugacggggaaaagcauccagcccgaaaaccucgaguaucgaaucaugcugucggugcacggaucucaacacuccgguaugauugucaaugauaccggcuacgaaacagacgagaaccgcgcaaagguggagguaacuccuaauucaccaagagcugaagccacccuugggggauucggcagucuggguuuggauugugagcccaggacagggcucgacuuuagcgaucuguauuacuuaacuaugaacaauaaacauuggcugguucacaaggaaugguuccaugacauaccucucccauggcacgcuggcgccgauaccggaacaccgcacuggaacaauaaagaggcacuuguggaauuuaaggacgcccaugcuaagcggcagaccgucgugguccugggcucccaggagggggcggugcacacugcauuggccggagcucuagaggccgaaauggauggugcaaaaggcaagcuguucucugggcaucucaaaugccgccugaagauggacaaacuuagacugaagggaguuagcuauucauuguguacggccgcuuuuacauucaccaaggugcccgccgagacucuccacggcaccguaacagucgaagugcaguacgcagguaccgacgggccuugcaaaaucccaguucaaauggcgguggauaugcagacucugacacccgucggcagguuaauuacggcuaacccugugaucaccgagaguacugaaaacuccaagaugaugcuggagcuagacccacccuuuggagauagcuacauaguaauuggcgugggggacaaaaagaucacacaucacuggcaccguucuggaucaaccaucgguaaagccuucgaggcaacaguucggggcgccaagcgaauggcuguccucggggauacugccugggacuucggaagugugggcgguguguuuaauagccuggggaagggcauucaucagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaa

SEQ ID NO: 1747 - RNA, 2136 nt, Artificial Sequence
  LC002520.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugaccgucaaugauauuggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaa

SEQ ID NO: 1748 - RNA, 2124 nt, Artificial Sequence
  KU963573.2 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugagaaucgagcaaaggucgaggugacaccuaacucaccacgcgcugaagccacucuugggggauucggcagucuggguuuggacugugagcccagaaccgggcucgauuuuagcgaccuguauuacuuaacaaugaauaacaaacacuggcugguacauaaggaaugguuccacgauauaccucucccauggcacgcuggcgccgacacuggaaccccgcauuggaauaacaaagaggcacuuguugaauuuaaggaugcccacgcuaagaggcagacaguggucgugcugggcucccaggagggggcgguccauaccgcauuggccggagcucuagaggccgaaauggacggugcaaaaggcaagcuguucucugggcaccucaaaugccggcugaagauggauaaacuucgccugaagggagugagcuauucauuguguacugccgcuuuuacguucacaaagguucccgccgagacccuccauggcacugugaccguagaaguccaguacgcagguacagacgggccuugcaaaaucccagugcaaauggcgguugacaugcagacccugacucccgugggcagauuaauuacagcuaauccugucaucacggagaguaccgaaaacuccaagaugaugcuggagcuagauccacccuuuggagacagcuacauagugauuggcguaggggauaaaaagaucacucaccacuggcauaggucuggaucaacaaucgguaaagccuucgaggcaaccgugcguggcgccaagcggauggcuguucucggggacacagccugggauuucggaagugucggcgguguguuuaacagccuggggaagggcauucaccagaucuucggagcagcuuuuaaaucccuuuucggcgggaugucuugguuuucgcaaauuuugauaggaacucugcucguguggcugggccuuaauaccaagaacgguagcaucucccugacguguuuggcccucgggggagucaugauuuuccugucaaccgcgguuagugccgacgugggcugcucuguggauuuuagcaaa

SEQ ID NO: 1749 - RNA, 2136 nt, Artificial Sequence
  KX694534.2 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggagaggcauccaccagauuuucggagccgcuuuuaaauccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaag

SEQ ID NO: 1750 - RNA, 2136 nt, Artificial Sequence
  KX447520.1 prME-long CDS opt
agaaucauuaacgccaggaaggagaaaaagcggcgcggcgcugacgcaagcguggggauagucggacugcuccuuaccacagccauggcggcugaaguuacucgacgugguuccgccuacuauauguaccuggauagaaaugacgcaggcgaggccaucucuuuccccacgaccuuggggaugaacaaaugcuauauucagaucauggauuuaggacacaugugugacgcuacaaugucauacgaaugcccuaugcuggaugagggcguggaaccagacgauguagacuguuggugcaauacuaccaguacauggguggucuaugguaccugucaucacaagaaaggggaggcaaggcggagccgcagagccgugacucuaccgucccauucuacaaggaagcuccaaacccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaa

SEQ ID NO: 1751 - RNA, 2136 nt, Artificial Sequence
  KX369547.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggacuggccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcgucggggagaaaaagauuacucaccacuggcaucguucuggaucaacaaucgguaaggcuuucgaggccaccgugcggggcgcaaaacgaauggcuguacugggggacacagccugggauuuuggaagugugggcggugcgcuuaacagcuuggggaaaggcauccaccagauuuucggagccgcuuucaagucccuguuuggcgggaugucuugguucucgcaaauccucauuggaacucugcuuauguggcugggcuugaauaccaagaacgguagcauaucccucaugugucuggcauuagggggaguucugaucuuucuaucaacggccgucagugcugacgugggcugcucuguggauuucagcaaa

SEQ ID NO: 1752 - RNA, 2136 nt, Artificial Sequence
  KX447515.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacugguaucguucuggaucaacaaucgguaaggcuuuugaggccaccgugcggggcgcaaaacgaauggcuguacucggggacacagccugggauuucggaagugugggcggugcgcugaacagccuugggaaaggcauccaucagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaa

SEQ ID NO: 1753 - RNA, 2136 nt, Artificial Sequence
  KU501217.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaauucguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaa

SEQ ID NO: 1754 - RNA, 2136 nt, Artificial Sequence
  KU312314.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacuggcccaaauggcagucgauaugcagaccuuaacucccgugggcaggcugaucacagccaacccuguuauuacggaaaguaccgaaaauuccaagaugaugcuagagcucgacccacccuucggagauagcuacaucgugauaggcgucggggagaaaaagauuacucaccacuggcaucguucuggaucaacaaucgguaaggcuuuugaggccaccgugcggggcgcaaaacgaauggcuguacugggggacacagccugggauuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugacgugggcugcucuguggauuuuagcaaa

SEQ ID NO: 1755 - RNA, 2136 nt, Artificial Sequence
  KX446950.2 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuacccuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaauacgaagaacgguagcauauccuugaugugucucgcauuagggggaguucugaucuuccugucaaccgccgucagugcugacgugggcugcucuguggauuuuagcaaa

SEQ ID NO: 1756 - RNA, 2136 nt, Artificial Sequence
  KY003157.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggucgugagugccgacgugggcugcucugucgauuuuagcaaa

SEQ ID NO: 1757 - RNA, 2136 nt, Artificial Sequence
  KX811222.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaagugcuuggguggucuaugguaccugucaucacaagaaaggggaggcaaggcggagccgcagagccgugacucuaccgucccauucuacaaggaagcuccaaacccggccccagacguggcuggagucgcgcgaauacacuaagcaccuuauucgaguugagaacuggaucuuuagaaauccuggauucgcucuggccgcggcagccauagcuugguugcucggcucaagcaccagucagaaagugaucuaucuggucaugauucugcucaucgccccagcauacuccauuaggugcaucggcgugucuaaccgggauuuuguagaagggaugagcggagguacauggguugacguggucuuagagcauggcgggugugugacugugauggcucaggauaagcccaccgucgacauagagcugguuacaaccacgguguccaauauggccgaaguacguucauacugcuaugaggcgaguauuagcgauauggccucugacucccgcuguccuacucaaggagaagcauaccuugacaaacagucagauacacaguaugugugcaagagaaccuuggucgacaggggcugggguaacggguguggacuguucggcaaaggcagccuagugacuugcgcuaaguuugccugcaguaagaaaaugacagggaagucuauccagccagagaaucucgaauaccggauuaugcuguccguucacggaagccaacacucggguaugaucgugaacgauaccggccaugagacggacgagaaucgagcuaaagucgaaaucacccccaacucuccucgcgccgaggcaacacuugggggauucggcucccuggguuuggauugugaaccaagaacugggcucgacuuuucagaucuguauuacuuaaccaugaauaacaagcacuggcuggugcauaaagagugguuccacgacauuccgcuccccuggcacgccggcgcugauacaggaacuccucauuggaauaacaaggaagcgcuuguagaguuuaaagacgcacacgccaagaggcagaccguugugguccugggcagucaggagggggcugugcauacagccuuggcaggagcccuagaagcugagauggauggugccaagggccggcugagcuccgggcaccucaaaugccgccugaagauggacaaacuuagacugaagggagucucuuauagcuuguguaccgcagcguucacuuuuacgaaaauaccagcugaaacacuccauggcaccgugacuguugaggugcaguacgccgguaccgacgggcccugcaagguaccugcacaaauggccgucgauaugcagacacugaccccagugggcagguuaaucacugcuaaccccguuauuacagaaucaacggagaauaguaagaugaugcuggagcuagacccgccuuucggagauuccuacaucgugauaggcgucggggagaaaaagauuacccaccacuggcaucguagcggaucuacuaucgguaaagccuuugaagcaacagugcggggcgcuaagcgaauggccguacucggggacaccgcgugggauuucggaucagugggcggugcccugaacagucuugggaaaggcauccaccagauuuucggagcugcauuuaagagcuuguucggcgggauguccugguuuucucaaauccugauuggaacacuccugauguggcuuggccugaauacuaagaacgguucgaucagcuugaugugucucgccuuagggggaguucugauauuccuguccaccgcugucucagccgacgugggcugcaguguggauuuuucuaaa

SEQ ID NO: 1758 - RNA, 2136 nt, Artificial Sequence
  KX447516.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacauccaaaaaggugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaaaccaacagucgacauagagcugguuaccacgacugugucaaauauggcugaaguacguaguuacugcuaugaggccagcauuucugauauggcguccgacucacgcugucccacacagggagaagccuaccuugacaagcaaagcgauacccaguaugugugcaaaagaacuuuggucgacaggggcugggguaacggguguggacuguucggcaagggcagucuagugacaugcgcaaaguuugcuugcucuaaaaagaugaccgggaaauccauccagccugagaaucucgaauaccggauuaugcugagcguucacggaucgcagcacucugguaugaucgugaacgauacgggccaugagaccgacgagaaucgagccaaggucgaaaucacaccaaacucaccccgcgcugaggccacucuugggggauucggcucccuggguuuggauugugaaccuagaaccgggcucgacuuuagugaucuguauuacuuaacaaugaauaacaaacacuggcuggugcauaaggagugguuccacgacauuccacucccguggcacgcaggcgccgauacuggaacaccccauuggaauaacaaagaagcucuuguagaguuuaaggacgcgcacgcaaagaggcaaaccguugugguccugggcagccaggagggggccgugcauaccgcuuuggccggagcacuagaagccgagauggauggugcuaaaggccggcuguccucugggcaccucaagugccgccugaaaauggacaagcugagacugaaaggagucagcuauucauuguguacugccgcauucacguuuacaaagauaccugcggaaacccuccauggcacugugaccguugaggugcaguacgcugguacagacgggccaugcaagguacccgcccagauggcagucgauaugcaaacccugacuccugugggcagguuaaucacagccaacccaguuauuacggaaaguaccgaaaauuccaaaaugaugcuggagcuagaucccccguucggagacagcuacaucgugauaggcgucggggagaagaaaauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaagggcauccaccagauuuucggagccgcuuuuaaguccuuguucggcgggaugucuugguuuucgcagauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaag

SEQ ID NO: 1759 - RNA, 2136 nt, Artificial Sequence
  KX520666.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaaggcagaaagugaucuaucuggucaugauucugcucaucgcuccugccuacuccauucggugcaucggcgugucuaaccgugauuuuguagaagggaugagcggagguacuuggguugacguggucuuagagcauggcgggugugugaccgugauggcacaggauaagccaacagucgacauagagcugguuaccacgacuguguccaauauggcugaaguacgcucauacugcuaugaggccaguauuagcgauauggcgucugacuccagaugucccacacaaggagaagccuaccuugacaaacagucagauacccaguaugugugcaagaggacuuuggucgaccggggcugggguaacggguguggacuguucggcaaaggcagccuagugacaugcgcaaaguuugcuugcaguaagaaaaugaccgggaagucuauccagccugagaaucucgaauaccgaauuaugcuguccguucacggaagccaacacucggguaugaucgugaacgauacgggccaugagaccgacgagaaucgcgccaaagucgaaaucacaccaaacucucccagagcugaggccacucuugggggauucggcucccuggguuuggauugugaaccuaggaccgggcucgacuuuucagaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagcggcagaccguugugguccugggcagucaggagggggccgugcauaccgcuuuggccggagcacuagaagccgagauggauggugcuaagggccgccugagcuccgggcaccucaaaugcagacugaagauggacaaacuuaggcugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggccguuuaaucacagccaacccaguuauuacggaaucaaccgagaauaguaagaugaugcuggagcuagaucccccguucggagacuccuacaucgugauaggcgucggggagaaaaagauuacucaccacuggcaucggagcggaucuacaaucgguaaggcuuuugaagccaccgugcgaggcgcaaaaagaauggcuguacucggggacacagccugggauuucggaucagugggcggugcgcugaacagucuugggaaaggcauccaccagauuuucggagccgcuuuuaagagcuuguucggcgggauguccugguuuucucaaauccugauuggaacucuccugauguggcuuggccugaauaccaagaacgguucgaucagcuugaugugucucgcauuagggggaguucugauauuccuguccacggccgucucagcugacgugggcugcaguguggauuuuucuaaa

SEQ ID NO: 1760 - RNA, 2136 nt, Artificial Sequence
  KU729218.1 prME-long CDS opt
agaaucauuaacgccaggaaggagaaaaagcggcgcagcgcugacaccuccgugggcauagucgggcugcuccuuacaacugcaauggccgcggaaguuacgcgacguggaucugcuuacuauauguaccuggauagaaaugacgccggugaggcaaucucauuccccaccacauugggcaugaacaaaugcuauauucagaucauggauuuagggcacaugugugacgccacuaugaguuacgaaugcccuaugcuggaugagggaguggaaccagacgauguagacuguuggugcaauaccacaagcaccuggguggucuauggcacuugucaucacaagaaaggugaggcuaggcggucccgcagagcagugacacuaccgucucauucgaccaggaagcuccaaacgcggucacagacuuggcuggagagccgcgaauacaccaagcaccuuauucgaguugagaacuggaucuuuagaaaucccggguucgcccuggcugccgcggcaauagccugguugcucggaaguuccacaucucagaaagugaucuaucuggucaugauucugcucaucgcuccugccuacagcauuaggugcaucggcguguccaaccgggauuuuguagaaggcaugucagggggaacuuggguugacguggucuuagagcaugguggcugugugaccgugauggcacaggauaagccaacagucgacauagagcugguuaccacgacugugaguaauauggcugaaguacguagcuacugcuaugaggccucuauuuccgauauggcgucagacagccgcugucccacacaaggggaagccuaccuugacaaacagagugauacccaguaugugugcaagagaacuuuggucgacaggggauggggcaacgguugugggcuguucggaaaaggcucucuagugacaugcgcaaaguuugcuugcuccaagaaaaugaccggcaagagcauccagccugagaaucucgaauaccggauuaugcugucgguucacgggucucaacacuccggaaugaucgugaacgauacgggucaugagaccgacgagaaucgagccaaagucgaaaucacaccaaacucaccccgcgcugaggccacucuuggcggguucggaagucugggcuuggauugugaaccuagaaccggucucgacuuuagcgaucuguauuacuuaacaaugaauaacaagcacuggcuggugcauaaagagugguuccacgacauuccacucccguggcacgcaggggccgauacuggcacaccccauuggaauaacaaggaagcucuuguagaguuuaaagacgcgcacgcaaagaggcagaccguugugguccugggaucccaggagggcgccgugcauaccgcuuuggccggggcacuagaagccgagauggauggagcuaagggucggcugucuagcggccaccucaaaugccgccugaagauggacaaacuuagacugaagggggucucauauaguuuguguacugccgcauucacguuuacaaaaauaccugcggaaacccuccauggaacugugaccguugaggugcaguacgcuggcacagacgguccaugcaagguacccgcccaaauggcagucgauacccagacucugacaccuguggggagguuaaucacggccaacccaguuauuaccgaauccacugagaauagcaagaugaugcuggagcuagaucccccguucggcgacucuuacaucgugauaggagucggcgagaaaaagauuacacaccacuggcaucguucagggaguaccaucggaaaggcuuuugaagccacagugcggggugcaaaacgaauggcuguacucggcgacacugccugggauuucgggagcgugggaggcgcgcugaacucccuugguaaagggauccaccagauuuucggcgccgcuuuuaagucuuuguucggaggcaugucgugguuuagccaaauccugauugggacccuccugauguggcuuggacugaauacgaagaacggcuccauaucauugaugugucucgcacugggugggguuuuaaucuuccugaguaccgccgucucugcugacgugggaugcagcguggauuuuuccaaa

SEQ ID NO: 1761 - RNA, 2136 nt, Artificial Sequence
  KU761561.1 prME-long CDS opt
agaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggaucuuuagaaaccccggauucgcccuggcugccgcggcaauagccugguugcucggcucaagcacaagucagaaagugaucuaucuggucaugauucugcucaucgcuccugccuacuccauuaggugcaucggcgugucuaaucgggauuuuguagaagggaugagcggagguacuuggguugacguggucuuagagcauggcgggugugugaccgugauggcacaggauaagccaacagucgacauagagcugguuaccacgacuguguccaacauggcugaaguacguucauacugcuaugaggccaguauuagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauccagccugagaaccucgaauaccggauuaugcuguccguucacggaagccaacacucggguaugaucgugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacauuccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaauccaguuauuacggaaucaaccgagaacaguaagaugaugcuggagcuagaucccccguucggagacuccuacaucgugauaggcgucggggagaaaaagauuacucaccacuggcaucguagcggaucuacaaucgguaaggcuuuugaagccaccgugcggggcgcacgaagaauggcuguacucggggacacagccugggauuucggaucagugggcggugcgcugaauagucuugggaaaggcauccaccagauuuucggagccgcuuuuaagagcuuguucggcgggauguccugguuuucucaaauccugauuggaacucuccugauguggcuuggccugaacaccaaaaaugguucgaucagcuugaugugucucgcauuagggggaguucugauauuccuguccacggccgucucagcugacgugggcugcaguguggauuuuucuaag

SEQ ID NO: 1762 - RNA, 2136 nt, Artificial Sequence
  KY317938.1 prME-long CDS opt
agaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggacuuuguagaggggauguccggagguacuuggguugauguggucuuagagcauggcgggugugugaccgugauggcacaggacaagccaacagucgauauagaacugguuaccacgacugugucaaauauggcugagguacguaguuacugcuaugaagccagcauuucugacauggcguccgauucacgcugucccacacaaggagaggccuaccuugacaaacagagcgacacccaguaugugugcaagagaacuuuggucgauaggggcugggguaacggguguggacuguucggcaaaggcagucuagugacaugcgcaaaguuugcuugcucuaagaaaaugaccgggaaguccauccagccugaaaaucucgaguaccggauuaugcugagcguucacggaucgcaacacucugguaugaucgugaacgacacgggccaugagaccgaugaaaaucgagccaaagucgagaucacaccaaacucaccccgcgcugaagccacucuugggggauucggcucccuggguuuggacugugagccuagaaccgggcucgauuuuagugaccuguauuacuuaacaaugaauaacaagcacuggcuggugcauaaagaaugguuccacgauauuccacucccguggcacgcaggcgccgacacuggaacaccccauuggaauaacaaggaggcucuuguagaguuuaaagaugcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaa

SEQ ID NO: 1763 - RNA, 2136 nt, Artificial Sequence
  KY075939.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuuuaaggugcauuggcgugagcaaccgggauuuuguagaagggauguccggagguacuuggguugacgugguccuggagcauggcgggugugugaccgugauggcacaggauaagccaacagucgacaucgagcuuguuaccacgacugugucaaauauggcugaaguacguaguuacugcuaugaggccagcauaucugauauggcguccgacucacgcugucccacacaaggagaagccuacuuggacaaacagagcgauacccaguaugugugcaagagaacucuggucgacaggggcugggguaacggguguggacuauucggcaaaggcagucucgugacaugcgcaaaguuugcuugcucuaagaaaaugaccgggaaguccauucagccugagaaucuggaauaccggaucaugcuuagcguucacggaucgcaacacucugguaugauugugaacgauacgggccaugagaccgacgagaaucgagccaaagucgaaaucacaccaaacucaccccgcgcugaggccacucugggaggguucggcuccuugggucucgauugugaaccuagaaccgggcuggacuuuagugauuuauauuaccugacaaugaauaacaagcacuggcucgugcauaaagagugguuccacgacaucccacuuccguggcacgcaggcgccgauacuggaacaccccauuggaauaacaaggaagcucugguagaguuuaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauucacguuuacaaaaauuccugcggaaacccugcauggcacugugaccguugaggugcaguacgcugguacagacgggccaugcaagguacccgcccaaauggcagucgauaugcagaccuuaacuccugugggcaggcugauaacagccaacccaguuaucacggaaaguaccgaaaauuccaagaugaugcuagagcucgaucccccguucggagacagcuacauugugaucggcgucggggagaaaaagauaacucaccacuggcaucguucuggaucaacaauugguaaggcuuuugaggccaccgugcggggcgcaaaacgaauggcuguacugggggacacagccugggauuucggaagugugggcggugcgcuuaacagcuuggggaaaggcauccaccagaucuucggagccgcuuuuaagucccuguucggcgggaugucuugguuuucgcaaauucucaucggaacucugcuuauguggcugggcuugaauaccaagaacgguagcauuucccucaugugucuggcauuagggggaguucugauauuccuaucaacggccgucagugcugacgugggcugcucuguggauuuuagcaaa

SEQ ID NO: 1764 - RNA, 2136 nt, Artificial Sequence
  KX806557.2 prME-long CDS opt
agaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggauguuuagaaaccccggauucgcccuggcugccgcggcaaucgccugguugcucggcucaagcacaagucagaaagugauauaucuggucaugauccugcucauugcuccugccuacuccaucaggugcauuggcgugucuaaucgggauuuuguagaagggaugagcggagguacuuggguugacguggucuuagagcauggcgggugugugaccgugauggcacaggauaagccaacagucgacaucgagcugguuaccacgacuguguccaacauggcugaaguacguucauacugcuaugaggccaguauaagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauucagccugagaaccucgaauaccggaucaugcuguccguucacggaagccaacacucggguaugauugugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacaucccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauuccugcggaaacccuccauggcacugugaccguugaggugcaguacgcugguacagacgggccaugcaagguacccgcccaaauggcagucgauaugcagacccugacuccugugggcagguuaauaacagccaauccaguuaucacggaaucaaccgagaacaguaagaugaugcuggagcuagaucccccguucggagacuccuacauugugaucggcgucggggagaaaaagauaacucaccacuggcaucguagcggaucuacaauugguaaggcuuuugaagccaccgugcggggcgcaaaacgaauggcuguacucggggacacagccugggauuucggaucagugggcggugcgcugaauagucuugggaaaggcauccaccagaucuucggagccgcuuuuaagagcuuguucggcgggauguccugguuuucucaaauucugaucggaacucuccugauguggcuuggccugaacaccaagaaugguucgauuagcuugaugugucucgcauuagggggaguucugauauuccuguccacggccgucucagcugacgugggcugcaguguggauuuuucuaaa

SEQ ID NO: 1765 - RNA, 2136 nt, Artificial Sequence
  KU870645.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggauccugagaaaucccggauuugccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcauuggggagaaaaagaucacucaccacuggcaucguucuggaucaacaaucgguaaggcuuucgaggccaccguccggggcgcaaaacgaauggcugugcugggggacacagccugggauuuuggaaguguaggcggugcgcuuaacagcuuggggaaaggcauucaccagaucuucggagccgcuuucaagucccuguuuggcgggaugucuugguucucgcaaauucucauaggaacucugcuuauguggcugggcuugaauaccaagaacgguagcaucucccucaugugucuggcauuagggggagugcugauuuuucuaucaacggccguuagugcugacgucggcugcucuguggauuucagcaaa

SEQ ID NO: 1766 - RNA, 2136 nt, Artificial Sequence
  KU729217.2 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuucaaccacggugaguaauauggcugaaguacguagcuacugcuaugaggccacuauuucugauaucgcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccgccguugugcugggcagccaggagggggcuguccauaccgccuuggcaggagcccuagaagcugagauggauggugccaagggccggcuguccucugggcaccucaaaugccgccugaagauggacaaacuuagacugaagggagugagcuauucauuguguacugcagcguucacguuuacaaaaaucccugcugaaacccuccauggcacugucaccguggagguucaguacgccgguacagacgggccaugcaaggugcccgcacaaauggccguagauaugcagacccugacuccugucggcagguuaauuacagcuaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaagccuuugaggcaaccguccggggcgcuaagcgaauggccgugcucggggacacagcgugggauuucggaaguguaggcggugcccugaacagccuugggaaaggcauucaccagaucuucggagcugcauuuaaguccuuguucggcgggaugucuugguuuucgcaaauucugauaggaacucuccugauguggcuuggccugaauaccaagaacgguagcaucuccuugaugugucucgccuuagggggagugcugauuuuccugucaacggcuguuagugccgacgucggcugcucuguggauuuuagcaaa

SEQ ID NO: 1767 - RNA, 2136 nt, Artificial Sequence
  KU497555.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacagcccccgcgcugaggccacucuugggggauucggcucacuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcacccaggagggggccgugcauacugcuuuggccggagcacuagaagccgagauggauggugcuaagggccggcugagcuccgggcaccucaaaugccgccugaagauggacaaacuuagacugaagggagucucuuauagcuuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaucaacugagaauaguaagaugaugcuggagcuagaucccccguucggagacuccuacaucgugauaggcgucggggagaaaaagauuacacaccacuggcaucguagcggaucuaccaucgguaaggcuuuugaagccacagugcggggcgcaaaacgaauggcuguacucggggacacugccugggauuucggaucagugggcggugcgcugaacagucuugggaaaggcauccaccagauuuucggagccgcuuuuaagagcuuguucggcgggauguccugguuuucucaaauccugauuggaacccuccugauguggcuuggccugaauacgaagaacgguucgauauccuugaugugucucgcauuagggggaguucugaucuuccuguccaccgccgucucagcugacgugggcugcaguguggauuuuucuaaa

SEQ ID NO: 1768 - RNA, 2136 nt, Artificial Sequence
  KX087101.3 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugagcugcaguacgcugguacagacgggccaugcaaggugcccgcccaaauggcaguagauaugcagaccuuaacuccugucggcaggcugaucacagccaacccagugauuacggaaaguaccgaaaauuccaagaugaugcuagagcucgaucccccguucggagacagcuacaucguuauaggcgugggggagaaaaagauuacucaccacuggcaucguucuggaucaacaaucgguaaggcuuuugaggccaccguccggggcgcaaaacgaauggcugugcugggggacacagccugggauuucggaaguguaggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggagugcugaucuuccuaucaacggccguuagugcugacgucggcugcucuguggauuuuagcaaa

SEQ ID NO: 1769 - RNA, 2136 nt, Artificial Sequence
  KY075932.1 prME-long CDS opt
agaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaaucgaaaacuggauauuuagaaaucccggauucgcccuggcugccgcggcaaucgccugguugcucggcagcaguacaucccagaaaguuauuuaucuggugaugauccugcucauugcuccugccuacucuaucaggugcauaggcgucagcaaccgggacuuuguggaggggauguccggagguacuuggguagauguuguguuagagcauggcgggugugucaccgugauggcacaggacaagccaacaguggauauugaacuggucaccacgacuguuucaaauauggcugaggugcguaguuacugcuaugaagccagcaucucugacauggcguccgauucacgcugucccacacaaggagaggccuaccuugacaaacagagcgacacccaguauguaugcaagagaacuuugguggauaggggcugggguaacggguguggacuguucggcaaaggcagucuagucacaugcgcaaaguuugcuugcucuaagaaaaugaccgggaaguccauucagccugaaaaucucgaguaccggaucaugcugagcgugcacggaucgcaacacucugguaugaucguuaacgacacgggccaugagaccgaugaaaaucgagccaaaguggagauuacaccaaacucaccccgcgcugaagccacucuugggggauucggcucccuggguuuggacugugagccuagaaccgggcucgauuuuagugaccuguauuacuuaacaaugaauaacaagcacuggcugguccauaaagaaugguuccacgauauaccacucccguggcacgcaggcgccgacacuggaacaccccauuggaauaacaaggaggcucuuguggaguuuaaagaugcgcacgcaaagaggcagaccguaguugugcugggcagccaggaaggggccguccauaccgcuuuggccggagcacuagaggccgaaauggacggugcuaagggccggcuguccucugggcaccucaaaugccgccugaagauggauaaacuuagacugaagggagugagcuauucauuguguacugccgcauucacguuuacaaaaaucccugcggagacccuccauggcacugucaccguggaaguucaguacgcugguacagacgggccaugcaaggugcccgcccaaauggcaguagacaugcagacccugacuccugucggcagguuaauuacagccaacccagugaucacggagaguaccgaaaauuccaagaugaugcuggagcuagaucccccguucggagacagcuacauaguuauuggcgugggggagaaaaagaucacucaccacuggcaucguucuggaucaacaaucgguaaggcuuuugaagccaccguccggggcgcaaaacgaauggcugugcucggggauacagccugggacuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugaugucggcugcucuguggacuuuagcaaa

SEQ ID NO: 1770 - RNA, 2136 nt, Artificial Sequence
  KY014317.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaucgaaaauuccaagaugaugcuggagcuagaucccccguucggagacagcuacauagugauuggcgucggggagaaaaagaucacccaccacuggcaucguucuggaucaacuaucgguaaggcuuuugaggccacagugcggggcgcaaaacgaauggcuguacucggggacaccgccugggauuucggaagugugggcggugcgcugaacagccuugggaaaggcauucaccagaucuucggagccgcuuuuaaguccuuguucggcgggaugucuugguuuucgcaaauucugauaggaacacuccugauguggcuuggccugaauacuaagaacgguagcaucuccuugaugugucucgcauuagggggaguucugauuuuccugucaaccgccgucagugcugacgugggcugcucuguggauuuuagcaaa

SEQ ID NO: 1771 - RNA, 2136 nt, Artificial Sequence
  KU758876.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugucaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuucauguguuuggcucucgggggaguccugaucuuuuuaucaacggcagugagugccgacgugggcugcucugucgauuucagcaaa

SEQ ID NO: 1772 - RNA, 2136 nt, Artificial Sequence
  KU758874.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggcaaacuguccucugggcaccucaagugccggcugaaaauggacaagcugcgccugaaaggagucagcuauucauuguguacugccgcauucacguuuacaaagauaccugcggaaacccuccauggcacugugaccguugaggugcaguacgcugguacagacgggccaugcaagguacccgcccaaauggcagucgauaugcagacccugacuccugugggcagauuaaucacagccaacccaguuauuacggaaaguaccgaaaauuccaaaaugaugcuggagcuagaucccccguucggagacagcuacaucgugauaggcgucggggagaagaaaauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaagggcauccaccagauuuucggagccgcuuuuaaguccuuguucggcgggaugucuugguuuucgcaaauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaag

SEQ ID NO: 1773 - RNA, 2136 nt, Artificial Sequence
  KY014314.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagaggcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaa

SEQ ID NO: 1774 - RNA, 2136 nt, Artificial Sequence
  KU926310.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcuggugccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaa

SEQ ID NO: 1775 - RNA, 2136 nt, Artificial Sequence
  KU761560.1 prME-long CDS opt
agaaucauuaacgccggcaaggagaaaaagaggcgcggggcugacaccaaugugggaauagucggucugcuccuuacaacugcaauggccgcggaaguuacgcggcgaggcagcgcuuacuauauguaccuggaucguaacgacgccggggaggcaaucuccuuccccaccacauugggaaugaauaaaugcuauauucagaucauggauuuaggccacaugugugacgccacuaugucuuacgaaugcccuaugcuggaugaggguguggaaccagacgauguagacuguuggugcaacaccacaucaaccuggguggucuaugggacuugucaucacaagaaaggagaggcuagaaggagucggcgcgcagugacacuaccgagccauuccaccagaaagcuccaaacgaggucucagacuuggcuggagucgcgggaauacaccaagcaccuuauucgcguugagaauuggaucuuucgaaaccccggcuucgcccuggcugccgcggcaauagccugguugcucggcucaagcacaagucagaaagugaucuaucuggucaugauucugcucaucgcuccugccuacuccauuagaugcaucggggugucuaauagggauuuuguagaaggaaugagcgguggcacuuggguugacguggucuuagagcaugggggaugugugaccgugauggcacaggauaagccaacagucgacauagagcugguuaccacgacuguguccaacauggcugaaguacggucauacugcuaugaggccaguauuagcgauauggcgucugacucccguugucccacacaaggcgaagccuaccuugacaaacagucagauacccaguaugugugcaagcgcacuuuggucgacagagguugggggaauggauguggccuguucggcaaagggagccuagugacaugcgcaaaguuugcuugcaguaagaaaaugaccggaaagucuauccagccugagaaccucgaauacaggauuaugcuguccguucacgguagccaacacucgggcaugaucgugaaugauacggggcaugagaccgacgagaaccgggccaaagucgaaaucacaccaaauucuccccgagcugaggccacucuuggaggcuucgguucccugggguuggauugugaaccucgcaccggccucgacuuuucagaucuguauuacuuaacaaugaacaauaagcacuggcuggugcauaaagagugguuccacgacauuccacucccguggcacgcaggagccgauacuggcacaccccauuggaacaacaaggaagcucuuguagaguuuaaagacgcgcacgcaaagagacagaccguugugguccuggggagucaggagggagccgugcauaccgcuuuggccggugcacuagaagccgagauggauggcgcuaaggggaggcugagcuccggacaccucaaaugccggcugaagauggacaaacuucgccugaagggcgucucuuauagcuuguguacugccgcauucacguuuacaaaaauaccugcggaaacccuccaugguacugugaccguugaggugcaguacgcugggacagacggcccaugcaagguacccgcccaaauggcagucgauaugcagacccugacuccugugggaagauuaaucacagccaauccaguuauuacggaaucaaccgagaacaguaagaugaugcuggagcuagaucccccguucggcgacuccuacaucgugauaggggucggagagaaaaagauuacucaccacuggcauaggagcgguucuacaaucggcaaggcuuuugaagccaccgugcguggggcacggcgaauggcuguacucggagacacagccugggauuucggcucaguggguggggcgcugaauagucuuggcaaaggaauccaccagauuuucggcgccgcuuuuaagagcuuguucgggggaauguccugguuuucucaaauccugauuggcacucuccugauguggcuuggucugaacaccaaaaaugggucgaucagcuugaugugucucgcacugggaggcguuuuaauauuccuguccacggccgucucagcugacguggguugcaguguggauuuuucuaag

SEQ ID NO: 1776 - RNA, 2136 nt, Artificial Sequence
  KY317939.1 prME-long CDS opt
agaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaagaugccggcgaagcaaucucuuuccccaccacauuggggaugaauaagugcuauauucagaucauggacuuaggacacaugugugaugccacuaugucauacgagugcccuaugcuggacgaaggcguggagccagaugacguagauuguuggugcaacaccacaaguaccuggguggucuaugguacuugucaucacaaaaagggggaggcuaggcggagccgcagagcagugacacuaccgucccauucuaccaggaagcuccaaacgcggucgcagacuuggcuggaaucacgcgaguacaccaaacaccuuauucgaguugaaaauuggaucuuuagaaaccccggauucgcccuggcugccgcggcaauagccugguugcucggcagcaguacaucccagaaggugaucuaucuggucaugauucugcucaucgcuccugccuacucuauuaggugcaucggcgugagcaaucgggacuuuguagaggggauguccggagguacuuggguugauguggucuuagagcauggcgggugugugaccgugauggcacaggacaaaccaacagucgauauagaacugguuaccacgacugugucaaacauggcugagguacguaguuacugcuaugaagccagcauuucugacauggcguccgauucacgcugucccacacaaggagaggccuaccuugacaagcagagcgacacccaguaugugugcaaaagaacuuuggucgauaggggcugggguaauggguguggacuguucggcaagggcagucuagugacaugcgcaaaguuugcuugcucuaaaaagaugaccgggaaauccauccagccugaaaaccucgaguaccggauuaugcugagcguucacggaucgcaacacucugguaugaucgugaaugacacgggccaugagaccgaugaaaaccgagccaaggucgagaucacaccaaauucaccccgcgcugaagccacucuugggggauucggcucccuggguuuggacugugagccuagaaccgggcucgauuuuagugaccuguauuacuuaacaaugaacaauaaacacuggcuggugcauaaggaaugguuccacgauauuccacucccguggcacgcaggcgccgacacuggaacaccccauuggaacaauaaagaggcucuuguagaguuuaaggaugcgcacgcaaagaggcagaccguugugguccugggcagccaggaaggggccgugcauaccgcuuuggccggagcacuagaggccgaaauggacggugcuaaaggccggcuguccucugggcaccucaagugccgccugaaaauggauaagcugagacugaaaggagucagcuauucauuguguacugccgcauucacguuuacaaagauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgagaacuccaaaaugaugcuggaacuagaucccccguucggagacagcuacaucgugauaggcgucggggagaagaaaauuacucaccacuggcaucguucuggaucaacaaucgguaaggcuuuugaagccaccgugcggggcgcaaaacgaauggcuguacucggggauacagccugggacuucggaagugugggcggugcgcugaauagccuugggaagggcauccaccagauuuucggagccgcuuuuaaguccuuguucggcgggaugucuugguuuucgcaaauccugauuggaacucuccugauguggcuuggccugaacaccaaaaaugguagcauauccuugaugugucucgcacuugggggaguuuuaaucuuccugucaacggccgucagugcugaugugggcugcucuguggacuuuagcaag

SEQ ID NO: 1777 - RNA, 2136 nt, Artificial Sequence
  KY075937.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauaugguguccgacucacgcugucccacacaaggagaagcguaccuugacaaacagagcgauacccaguaugucugcaagagaacuuugguggacaggggcugggguaacggguguggacuguucggcaaaggcagucuaguuacaugcgccaaguuugcaugcucuaagaaaaugaccgggaaguccauccagccugagaaucucgaauaccggauuaugcugagcgugcacggaucgcaacacucugguaugaucgucaacgauacgggccaugagaccgacgagaaucgagcuaaaguggaaaucacaccaaacucaccccgcgccgaggcuacucuugggggauucggcucccuggguuuggauugugaaccuagaaccgggcucgacuuuagugaucuguauuacuuaacaaugaauaacaagcacuggcugguacauaaagagugguuccacgacauuccacucccguggcacgccggcgcagauacuggaacaccccauuggaauaacaaggaagcccuuguugaguuuaaagacgcucacgcgaagaggcagaccguggucgugcugggcagccaggagggggcaguccauaccgccuuggcuggagcccuagaagcagagauggauggugccaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuugaugugucucgcuuuagggggaguccugaucuuccugucaacggcagugagugccgacgugggcugcucugucgauuuuagcaaa

SEQ ID NO: 1778 - RNA, 2136 nt, Artificial Sequence
  LC191864.1 prME-long CDS opt
agaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaugaccucaacauggguggucuaugguaccugucaucacaagaaaggggaggcuaggcggagucgcagagcagugacucuaccgagccauuccacaaggaagcuccaaacccggucucagacguggcuggagucgcgcgaauacacuaagcaccuuauucgaguugagaauuggaucuuuagaaaccccggauucgcccuggcugccgcggcaauagccugguugcucggcucaagcaccagucagaaagugaucuaucuggucaugauucugcucaucgcuccugccuacuccauuaggugcaucggcgugucuaaucgggauuuuguagaagggaugagcggagguacauggguugacguggucuuagagcauggcgggugugugacugugauggcacaggauaagccaaccgucgacauagagcugguuacaaccacgguguccaacauggcugaaguacguucauacugcuaugaggccaguauuagcgauauggcgucugacucccgcugucccacucaaggagaagccuaccuugacaaacagucagauacacaguaugugugcaagagaaccuuggucgacaggggcugggguaauggguguggacuguucggcaaaggcagccuagugacuugcgcaaaguuugcuugcaguaagaaaaugacagggaagucuauccagccugagaaccucgaauaccggauuaugcuguccguucacggaagccaacacucggguaugaucgugaaugauaccggccaugagacggacgagaaccgagccaaagucgaaaucaccccaaauucuccccgcgcugaggccacacuugggggauucggcucccuggguuuggauugugaaccuagaacugggcucgacuuuucagaucuguauuacuuaaccaugaacaauaagcacuggcuggugcauaaagagugguuccacgacauuccacucccguggcacgcaggcgccgauacaggaacuccccauuggaacaacaaggaagcucuuguagaguuuaaagacgcgcacgcaaagaggcagaccguugugguccugggcagucaggagggggccgugcauacagcuuuggccggagcacuagaagccgagauggauggugcuaagggccggcugagcuccgggcaccucaaaugccgccugaagauggacaaacuuagacugaagggagucucuuauagcuuguguaccgccgcauucacuuuuacgaaaauaccugcggaaacacuccauggcaccgugacuguugaggugcaguacgcugguaccgacgggccaugcaagguacccgcccaaauggcagucgauaugcagacacugaccccugugggcagguuaaucacugccaauccaguuauuacagaaucaacggagaacaguaagaugaugcuggagcuagaucccccguucggagacuccuacaucgugauaggcgucggggagaaaaagauuacccaccacuggcaucguagcggaucuacuaucgguaaggcuuuugaagccacagugcggggcgcaaaacgaauggcuguacucggggacaccgccugggauuucggaucagugggcggugcgcugaauagucuugggaaaggcauccaccagauuuucggagccgcuuuuaagagcuuguucggcgggauguccugguuuucucaaauccugauuggaacacuccugauguggcuuggccugaacacuaagaaugguucgaucagcuugaugugucucgcauuagggggaguucugauauuccuguccaccgccgucucagcugacgugggcugcaguguggauuuuucuaaa

SEQ ID NO: 1779 - RNA, 2136 nt, Artificial Sequence
  KX447517.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccgcacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaacacugaucggaacucuccugauguggcuuggccugaauaccaagaacgguagcauuuccuugaugugucucgccuuagggggaguucugauauuccugucaacggcugucagugccgacgugggcugcucuguggauuuuagcaaa

SEQ ID NO: 1780 - RNA, 2136 nt, Artificial Sequence
  KU922923.1 prME-long CDS opt
agaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuuuagccuacucuauuaggugcaucggcgugagcaaccgggacuuuguagaggggauguccggagguacuuggguugaugugguccuggagcauggcgggugugugaccgugauggcacaggacaagccuacagucgauauagaacuuguuaccacgacugugucaaauauggcugagguacguaguuacugcuaugaagccagcauuucugacauggcguccgauucacgcuguccaacacaaggagaggccuacuuggacaaacagagcgacacccaguaugugugcaagagaacucuggucgauaggggcugggguaacggguguggacuauucggcaaaggcagucucgugacaugcgcaaaguuugcuugcucuaagaaaaugaccgggaaguccauccagcccgaaaaucuggaguaccggauuaugcuuagcguucacggaucgcaacacucugguaugaucgugaacgacacgggccaugagaccgaugaaaaucgagccaaagucgagaucacaccuaacuccccacgcgcugaagccacucugggaggguucggcucauugggucucgacugugagcccagaaccgggcuggauuuuagugacuuauauuaccugacaaugaauaacaagcacuggcucgugcauaaagaaugguuccacgauauuccucuuccauggcacgcaggcgccgacacuggaaccccgcauuggaauaacaaggaggcucugguagaguuuaaagaugcgcacgcaaagaggcagacaguuguggucuugggcagccaggaaggggccgugcauaccgcucuagccggagcacuggaggccgaaauggacggugcuaagggccggcucuccucugggcaccugaaaugccgccuuaagauggauaaacugagauugaagggagucagcuauucacucuguacugccgcauucacguuuacaaaaauacccgcggagacccugcauggcacugugaccguugaagugcaguacgcugguacagacgggccuugcaagguaccagcccaaauggcagucgacaugcagaccuuaacucccgugggcaggcugaucacagccaacccuguuauuacggagaguaccgaaaauuccaagaugaugcuagagcucgauccacccuucggagacagcuacaucgugauaggcgucggggagaaaaagauuacucaccacuggcaucguucuggaucaacaaucgguaaggcuuuugaagccaccgugcggggcgcaaaacgaauggcuguacugggggauacagccugggacuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugaugugggcugcucuguggacuuuagcaaa

SEQ ID NO: 1781 - RNA, 2136 nt, Artificial Sequence
  KY003156.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcauaagcaaccgggauuuuguggaagggauguccggagguacuuggguagacguuguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcauacuggguuuggauugugaaccuagaaccgggcucgacuuuuccgaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagaggcagaccguaguugugcugggcagucaggagggggccguccauaccgcuuuggccggagcacuagaagccgagauggauggugcuaagggccggcugagcuccgggcaccucaaaugccgccugaagauggacaaacuuagacugaagggagugucuuauagcuuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagguuaaucacagccaacccagugauaacggaaucaaccgagaauaguaagaugaugcuggagcuagaucccccguucggagacuccuacauuguuaucggcgugggggagaaaaagaucacucaccacuggcaucguagcggaucuacaauugguaaggcuuuugaagccaccguccggggcgcaaaacgaauggcugugcucggggacacagccugggauuucggaucaguaggcggugcgcugaacagucuugggaaaggcauccaccagauuuucggagccgcuuuuaagagcuuguucggcgggauguccugguuuucucaaauacugaucggaacucuccugauguggcuuggccugaauaccaagaacgguucgauuagcuugaugugucucgcauuagggggagugcugaucuuccuguccacggccguuucagcugacgucggcugcaguguggauuuuucuaaa

SEQ ID NO: 1782 - RNA, 2136 nt, Artificial Sequence
  KU312313.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuauuaggaagcuccaaacgcggucgcagacuuggcuggagucacgcgaauacaccaagcaccuuauccgaguugagaacuggauauuuagaaaucccggauucgcccuggcugccgcggcaaucgccugguugcucggcagcaguacaucccagaaagugauuuaucuggucaugauccugcucauugcuccugccuacucuaucaggugcauaggcgugagcaaccgggauuuuguagaagggauguccggagguacuuggguugacguggucuuagagcauggcgggugugugaccgugauggcacaggauaagccaacagucgacauugagcugguuaccacgacugugucaaauauggcugaaguacguaguuacugcuaugaggccagcaucucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaaucccugcggaaacccuccauggcacugugaccguugaggugcaguacgcugguacagacgggccaugcaagguacccgcccaaauggcagucgauaugcagacccugacuccugugggcagguuaauuacagccaacccaguuaucacggaaaguaccgaaaauuccaagaugaugcuggagcuagaucccccguucggagacagcuacauagugauuggcgucggggagaaaaagaucacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauucaccagaucuucggagccgcuuuuaaguccuuguucggcgggaugucuugguuuucgcaaauucugauaggaacucuccugauguggcuuggccugaaugcaaagaacgguagcaucuccuugaugugucucgccuuagggggaguucugauuuuccugucaaccgcugucagugccgacgugggcugcucuguggauuuuagcaaa

SEQ ID NO: 1783 - RNA, 2136 nt, Artificial Sequence
  KY075935.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcucaaaggagccggcgcgcagugacacuaccgucccauucuaccagaaagcuccagacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacguggucuuagagcauggcgggugugugaccgugauggcacaagauaagccaacagucgacauagagcugguuaccacgacugugucaaauauggcugaaguacggaguuacugcuaugaggccagcauuucugauauggcguccgacucacguugucccacacagggagaagccuaccuugacaaacagagcgauacccaguaugugugcaagcgcacuuuggucgacagaggcugggguaacggguguggacuguucggcaaaggcagucuagugacaugcgcaaaguuugcuugcucuaagaaaaugaccgggaaguccauccaaccugagaaucucgaauacaggauuaugcugagcguucacggaucgcagcacucugguaugaucgugaacgauacgggccaugagaccgacgagaaucgggccaaagucgaaaucacaccaaacucaccccgagcugaggccacucuugggggauucggcucccuggguuuggauugugaaccucgcaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagagacagaccguugugguccugggcagccaggagggggccgugcauaccgcuuuggccggagcacuagaagccgagauggauggugcuaagggcaggcuguccucugggcaccucaaaugccggcugaagauggacaaacuucgccugaagggagucagcuauucauuguguacugccgcauucacguuuacaaaaauaccugcggaaacccuccauggcacugugaccguugaggugcaauacgcugguacagacgggccaugcaagguacccgcccagauggcagucgauaugcagacccugacuccugugggcagauuaaucacagccaacccaguuauuacggaaaguaccgaaaauuccaagaugaugcuggagcuagaucccccguucggagacagcuacaucgugauaggcgucggggagaaaaagauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaaaggcauccaccaaauuuucggagccgcuuuuaaguccuuguucggcgggaugucuugguuuucgcagauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaa

SEQ ID NO: 1784 - RNA, 2136 nt, Artificial Sequence
  KY014320.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaagcccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaa

SEQ ID NO: 1785 - RNA, 2136 nt, Artificial Sequence
  KX827309.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaucugacgccggcgaggcaaucucauuccccaccacauuggggaugaauaaaugcuauauucagaucauggauuuaggacacaugugugacgccacuaugaguuacgaaugcccuaugcuggaugagggcguggaaccagacgauguagacuguuggugcaacaccacaagcaccuggguggucuaugguacuugucaucacaagaaaggggaggcuaggcggucccgcagagcagugacacuaccgucucauucgaccaggaagcuccaaacgcggucacagacuuggcuggagagccgcgaauacaccaagcaccuuauucgaguugagaauuggaucuuuagaaaccccggauucgcccuggcugccgcggcaauagccugguugcucggcaguuccacaucucagaaagugaucuaucuggucaugauucugcucaucgcuccugccuacagcauuaggugcaucggcguguccaaucgggauuuuguagaagggaugucaggagguacuuggguugacguggucuuagagcauggcgggugugugaccgugauggcacaggauaagccaacagucgacauagagcugguuaccacgacugugaguaacauggcugaaguacguagcuacugcuaugaggccucuauuuccgauauggcgucagacagccgcugucccacacaaggagaagccuaccuugacaaacagagugauacccaguaugugugcaagagaacuuuggucgacaggggcugggguaauggguguggacuguucggcaaaggcucucuagugacaugcgcaaaguuugcuugcuccaagaaaaugaccgggaaaagcauccagccugagaaccucgaauaccggauuaugcugucgguucacggaucucaacacuccgguaugaucgugaaugauacgggccaugagaccgacgagaaccgagccaaagucgaaaucacaccaaauucaccccgcgcugaggccacucuugggggauucggcagucuggguuuggauugugaaccuagaaccgggcucgacuuuagcgaucuguauuacuuaacaaugaacaauaagcacuggcuggugcauaaagagugguuccacgacauuccacucccguggcacgcaggcgccgauacuggaacaccccauuggaacaauaaggaagcucuuguagaguuuaaagacgcgcacgcaaagaggcagaccguugugguccugggcucccaggagggggccgugcauaccgcuuuggccggagcacuagaagccgagauggauggugcuaagggccggcugucuagcgggcaccucaaaugccgccugaagauggacaaacuuagacugaagggagucucauauaguuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaauccaccgagaacagcaagaugaugcuggagcuagaucccccguucggagacucuuacaucgugauaggcgucggggagaaaaagauuacucaccacuggcaucguucaggaaguacaaucgguaaggcuuuugaagccaccgugcggggcgcaaagcgaauggcuguacucggggacacagccugggauuucggaagcgugggcggugcgcuuaauucccuggggaaaggcauccaccagauuuucggagccgcuuuuaagucuuuguucggcgggaugucgugguuuagccaaauccugauuggaacucuccugauguggcuuggccugaacaccaagaaugguuccauaucauugaugugucucgcauuagggggaguucugaucuuccugaguacggccgucucugcugacgugggcugcagcguggauuuuuccaaa

SEQ ID NO: 1786 - RNA, 2136 nt, Artificial Sequence
  KU681081.3 prME-long CDS opt
agaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacaccggcgccgauacaggaacuccccauuggaacaauaaggaagcacuuguagaguuuaaagacgcccacgcuaagaggcagaccguugugguccugggcucccaggagggggcggugcauacggcauuggccggagcucuagaagccgagauggauggugcaaagggccggcugucuagcgggcaccucaaaugccgccugaagauggacaaacuuagacugaagggagucucauauaguuuguguacagccgcuuucaccuuuacuaaaauaccugccgaaacccuccauggcacagugaccguugaggugcaguacgcagguacugacgggccaugcaagguacccgcgcaaauggcugucgauaugcagacacugacgccugugggcagguuaaucaccgccaacccaguuauuacugaaggaacagagaacuccaagaugaugcuggagcuagaucccccguucggcgacagcuacaucgugauaggggucggagaaaagaagauuacccaccacuggcaucguucugguucaacaaucggcaaagcauuugaggccacugugcgaggggcuaagcggauggccguacucggagacaccgcaugggauuucggcagugugggugggguucugaauagccuuggcaaaggaauccaccagauuuucggcgcugccuuuaaguccuuguucgggggaaugucuugguuuucgcaaauccugauuggcacgcuccugauguggcuuggucugaacaccaagaaugggagcauauccuugaugugucucgcgcugggaggcgucuuaaucuuccugucaacagccgugagugcugacguggguugcucugucgauuuuagcaaa

SEQ ID NO: 1787 - RNA, 2136 nt, Artificial Sequence
  KU744693.1 prME-long CDS opt
agaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgcaauggcucaggauaagccaacaguggacauagagcuggucaccacgacuguuucaaauauggccgaagugcguaguuacugcuaugaggcgagcauuucugauauggccuccgacucacgcugucccacacaaggagaagcauaccuugacaaacagagcgauacccaguauguaugcaagagaacuuugguggacaggggcugggguaacggguguggacuguucggcaaaggcagucuagucacaugcgcuaaguuugccugcucuaagaaaaugaccgggaaguccauccagccugagaaucucgaauaccggauuaugcugagcgugcacggaucgcaacacucugguaugcuuguuaacgauacgggccaugagaccgacgagaaucgagcuaaaguggaaaucacaccaaacucaccccgcgccgaggcaacucugggaggguucggcuccuugggucucgauugugaaccuagaaccgggcuggacuuuagugauuuauauuaccugacaaugaauaacaagcacuggcucgcccauaaagagugguuccacgacaucccacuuccguggcacgcuggcgcggcaacuggaacaccccauuggaauaacaaggaagcccuggucgaguuuaaagaugcucacgccaagaggcagaccgugguaguuuugggcagccaggagggggcagugcauaccgcccuagcuggagcccuggaagcagagauggacggugcgaagggccggcucuccucugggcaccugaaaugccgccuuaagauggauaaacugagauugaagggagucagcuauucacucuguacugcugccuucacguuuacaaaaauuccugcagaaaccguggacggcacugucaccguggagggucaguacgggggcacagacggaccaugcaagguucccgcccaaauggcuguggauaugcagacccugacuccuguaggcagguuaauaacagccaacccagucaucacggaaaguaccgaaaauuccaagaugaugcuggagcuagaucccccguucggggacagcuacauugugaucggaguuggugagaaaaagauaacucaucacuggcaccguucuggcucaacaauugggaaagcauuugaggcuaccgugcggggagccaagcgaauggcgguccucggcgacacagccugggauuucgguaguguagggggcgcucugaacagccuuggaaaaggcauccaucagaucauuggggcagccuucaaguccuuguuuggaggcaugucuugguucucgcaaauccugauugguacucuccugauguggcuugggcugaauaccaagaacggaagcauauccuugaugugucucgcucugggcgguguguuaaucuuucugucaacggccgugaguggcgggguuggaugcucugucgacuucagcaaa

SEQ ID NO: 1788 - RNA, 2136 nt, Artificial Sequence
  KY328290.1 prME-long CDS opt
agaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaagucuauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuuccaaaauaccugcagaaacccuccauggcacugugaccgaggaaguucaguacgcggguacagacgggccaugcaaggugcccgcucaaauggccguagauaugcagacccugacuccugucggcagguuaaucacagcaaacccagugauuacggagagcaccgagaacucuaagaugaugcuggaacuagaucccccguucggagacucauacaucguuauaggcgugggggagaaaaagauuacucaccacuggcaucguaguggaagcacaaucgguaaagccuuugaagcuaccguccggggcgccaagcgaauggcagugcucggggacacagcuugggauuucggauccguaggcggugcccugaauagccuugggaaaggcauccaccagauuuucggagcggccuuuaagucguuguucggcgggaugagcugguuuucccaaauccugauuggaacucuccugauguggcuuggccugaacaccaagaaugguucaauaaguuugaugugucucgcuuuagggggagugcugaucuuccugucuacggcaguuagcgccgacgucggcugcuccguggauuuuucaaaa

SEQ ID NO: 1789 - RNA, 2136 nt, Artificial Sequence
  KX694532.2 prME-long CDS opt
agaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugaugugucucgcuuuagggggaguucugaucuuccugaguaccgcagucucugccgacgugggcugcagcguggauuuuuccaaa

SEQ ID NO: 1790 - RNA, 2136 nt, Artificial Sequence
  KU955593.1 prME-long CDS opt
agaaucauuaacgccaggaaggagaaaaagcggcgcggcaccgacacaagcguggggauagucggacugcuccuuacuacggcuauggcaguugaagugacccgacgugguaaugccuacuauauguaccuggauagauccgacgcgggcgaggcuaucucuuuccccacaacuauggggaugaacaaaugcuauauucagaucauggauuugggacacaugugugacgccaccaugucauacgaaugcccuauguuagaugagggcguagaaccagacgauguggacuguuggugcaauacaaccaguacuugggucguguaugguacaugucaucacaagaaaggggaggcaaggcggagccgcagagccguuacccugccgucccauucuacgaggaagcuacaaacucggucgcagaccuggcucgagucacgcgaauacacaaagcaccugauucgaguggagaacuggaucuuuagaaaucccggauucgcucuugcagccgcugccauagcguggcuguugggcagcaguacuucccagaaagucaucuaucucgugaugauucugcugaucgcacccgccuacucuauuaggugcaucggcguaagcaaccgggauuuuguugaagggauguccggagguaccuggguggacgucgugcucgagcauggcgggugugugacagucauggcucaggauaagccaaccguugacauagaguuagugacgacuacaguaucaaauauggccgaagugcguaguuacugcuaugaggcaagcauuucugauauggcuuccgacucacgcugucccacccaaggagaagccuaccuggacaaacagagcgauacucaguaugucugcaagagaacacuuguggacaggggcugggguaacggguguggauuguucggcaaaggcagucugguuaccugcgcgaaguuugccugcucuaagaaaaugacggggaaguccauccagccugagaaucuagaauaccggauuaugcucagcgugcacggaucgcaacacucugguaugaucgucaacgauaccggccaugagacagacgagaaucgagcaaaaguggaaaucacuccaaacuccccucgcgcugaggccacccuugggggauucggcucacugggucuggauugugaaccuagaacaggguuggacuuuagugaucucuauuaccugacuaugaauaacaagcacugguuaguacauaaagagugguuccacgacauuccacugccguggcacgcuggcgccgauaccggaacaccccauuggaauaacaaggaagcacucguugaguuuaaagacgcccacgcuaagaggcagaccguggucgugcuuggcagccaggagggggcgguccauacugcacuggccggagcuuuggaagccgagauggauggugcaaagggccggcuauccucugggcaccugaaaugccgccucaagauggacaaacugagacuuaagggagugagcuauucacuguguacggccgcuuucacauuuaccaaaauaccugccgaaacuuugcauggcaccguuacaguggagguacaguacgcagguaccgacgggccaugcaagguccccgcgcaaauggcuguggauaugcagacucucacaccuguuggcaggcugaucacggccaacccagugauuaccgaaaguacugaaaauuccaagaugauguuagagcuggaucccccguucggagacagcuacaucgucauaggcgugggggagaaaaagauuacacaccacuggcaucguucuggaucaaccaucgguaaagcauuugaggccacaguacggggcgcuaagcgaauggccgugcuaggggacacugcaugggauuucggaaguguuggcggugcucucaacagccuggggaaaggcauccaccagauuuucggagccgcguuuaagucccuuuucggcgggaugucuugguuuucgcaaaucuugauuggaacccugcucgucuggcugggccuuaauacgaagaacgguagcauaucccugauguguuuggcccucgggggagugcugaucuucuuaucaaccgcugugagugcagacgucggcugcucuguugauuuuagcaaa

SEQ ID NO: 1791 - RNA, 2136 nt, Artificial Sequence
  KY272987.1 prME-long CDS opt
agaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugguuugucucgcuuuagggggaguccugaucuuccugaguaccgcagugucugccgacgugggcugcagcgucgauuuuuccaaa

SEQ ID NO: 1792 - RNA, 2136 nt, Artificial Sequence
  EU545988.1 prME-long CDS opt
agaaucauuaacgccaggaaggagaaaaagcggcgcggcaccgacacaagcguggggauagucggacugcuccuuacuacggcuauggcaguugaagugacccgacgugguuccgccuacuauauguaccuggauagaucugacgcgggcgaggcuaucucauuccccacaacuuuggggaugaauaaaugcuauauucagaucauggauuuaggacacaugugugacgccaccaugaguuacgaaugcccuaugcuggaugagggcguagaaccagacgauguggacuguuggugcaacacaaccagcacuugggucguguaugguacaugucaucacaagaaaggggaggcaaggcggucccgcagagccguuacccuaccgucucauucgacgaggaagcuccaaacucggucacagaccuggcuggagagccgcgaauacacaaagcaccuuauucgaguggagaauuggaucuuuagaaaccccggauucgcucuggcagccgcugccauagcgugguugcucggcaguuccacuucucagaaagucaucuaucuggugaugauucugcucaucgccccugcauacagcauuaggugcaucggcguauccaaucgggauuuuguugaagggaugucaggagguaccuggguggacgucguguuagagcauggcgggugugugacagucauggcucaggauaagccagccguugacauagagcuggugaccacgacuguaaguaacauggcagaagugcguagcuacugcuaugaggcuucuauuuccgauauggccucagacagccgcugucccacacaaggagaagcguaccuugacaaacagagugauacccaguaugucugcaagagaacuuugguggacaggggcugggguaauggguguggacuguucggcaaaggcucucuaguuacaugcgccaaguuugcaugcuccaagaaaaugaccgggaaaagcauccagccugagaaccucgaauaccggauuaugcugucggugcacggaucucaacacuccgguaugaucgucaaugauacgggccaugagaccgacgagaaccgagcuaaaguggaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguacauaaagagugguuccacgacauuccacucccguggcacgccggcgcagauacuggaacaccccauuggaacaauaaggaagcccuuguugaguuuaaagacgcucacgcgaagaggcagaccguggucgugcugggcucccaggagggggcaguccauaccgccuuggcuggagcccuagaagcagagauggauggugccaagggccggcugucuagcgggcaccucaaaugccgccugaagauggacaaacuuagacugaagggagugucauauaguuuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaauccaccgagaacagcaagaugaugcuggagcuagaucccccguucggagacucuuacaucgucauaggcgugggggaaaagaagauuacucaccacuggcaucguucaggaaguacaaucgguaaagccuuugaggcuaccguacggggcgccaagcgaauggcagugcucggggacacagcuugggauuucggaagcguuggcggugcccuuaauucccuggggaaaggcauccaccagauuuucggagcggccuuuaagucuuuguucggcgggaugucgugguuuagccaaauccugauuggaacucuccuggucuggcuuggccugaacaccaagaaugguuccauaucauugacgugucucgcuuuagggggagugcugaucuuccugaguaccgcagugucugccgacgucggcugcagcguugauuuuuccaaa

SEQ ID NO: 1793 - RNA, 2136 nt, Artificial Sequence
  KU681082.3 prME-long CDS opt
agaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggaugaauaaaugcuauauucagaucauggauuuaggacacaugugugacgcaacuaugaguuacgaaugcccuaugcuggaugagggcguagaaccagacgauguggacuguuggugcaacaccacaagcaccugggucguguaugguacuugucaucacaagaaaggggaggccaggcggucccgcagagcuguuacacuaccgucucauucgaccaggaagcuccaaacgcggucacagacuuggcuggagagccgcgaauacaccaagcaccuuauucgaguggagaauuggaucuuuagaaaccccggauucgcacuggccgcugccgucauagcgugguugcucggcaguuccacaucucagaaagugaucuaucugguaaugauucugcucaucgccccugcauacagcauuaggugcaucggcguuuccaaucgggauuuuguggaagggaugucaggagguacuugggucgacgugguguuagagcauggcgggugugucaccguuauggcucaggauaagccaacaguggacauagagcugguaaccacgacugugaguaacauggccgaaguccguagcuacugcuaugaggcaucuauuuccgauauggcuucagacagccgcugucccacacaaggagaagccuaccuugacaaacagagugauacccaguaugugugcaagagaacuuugguugacaggggcugggguaauggguguggacuguucggcaaaggcucucuagugacaugcgcgaaguuugccugcuccaagaaaaugaccgggaaaagcauccagccugagaaccucgaauaccggauuaugcugucgguccacggaucucaacacuccgguaugaucgugaaugauacgggccaugagaccgacgagaaccgagcaaaaguagaaaucacaccaaauucaccccgcgcugaggccacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgcuggcgccgauacuggaacaccccauuggaacaauaaggaagcacuuguggaguuuaaagacgcccacgcuaagaggcagaccgucgugguccugggcucccaggagggggcggugcauaccgcauuggccggagcucuagaagccgagauggauggugcaaagggccggcugucuagcgggcaccucaaaugccgccugaagauggacaaacuuagacugaagggaguuucauauaguuuguguacugccgcuuucacguuuacaaaaauaccugccgaaacccuccauggcacugugaccguagagguccaguacgcagguacagacgggccaugcaaggugcccgcgcaaauggcuguugauaugcagacccugacuccugugggcagguuaaucacagccaacccagucauuacggaauccaccgagaacagcaagaugaugcuggagcuagaucccccguucggagacucuuacaucgugauaggcguaggggaaaagaagauuacucaccacuggcaucguucaggaaguacaaucgguaaagcauuugaggccaccgugcggggcgcuaagcgaauggccguucucggggacacagcaugggauuucggaagcgucggcggugcucuuaauucccuggggaaaggcauccaccagauuuucggagccgcguuuaagucuuuguucggcgggaugucgugguuuagccaaauccugauuggaacucuccugguguggcuuggccugaacaccaagaaugguuccauaucauugacgugucucgccuuagggggagugcugaucuuccugaguaccgcugucucugcagacguuggcugcagcguggauuuuuccaaa

SEQ ID NO: 1794 - RNA, 2136 nt, Artificial Sequence
  KX601167.1 prME-long CDS opt
agaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggguaaauaaaugcuauauucagaucauggauuuaggacacaugugugacgcaacuaugaguuacgaaugcccuaugcuggaugagggcguggaaccagacgaugucgacuguuggugcaacaccacaagcaccugggugguuuaugguacuugucaucacaagaaaggggaggccaggcggucccgcagagcugugacacuaccgucucauucgaccaggaagcuccaaacgcggucacagacuuggcuggagagccgcgaauacaccaagcaccuuauucgagucgagaauuggaucuuuagaaaccccggauucgcacuggccgcugccgcgauagcaugguugcucggcaguuccacaucucagaaagugaucuaucugguaaugauucugcucaucgccccugcuuacagcauuaggugcaucggcguuuccaaucgggauuuuguggaagggaugucaggagguacuugggucgacgugguguuagagcauggcgggugugucaccguuauggcccaggauaagccaacaguggacauagagcugguaaccacgacugugaguaacauggcagaaguccguagcuacugcuaugaggcuucuauuuccgauauggccucagacagccgcugucccacacaaggagaagcguaccuugacaaacagagugauacccaguaugugugcaagagaacuuugguugacaggggcugggguaauggguguggacuguucggcaaaggcucucuagugacaugcgccaaguuugcaugcuccaagaaaaugaccgggaaguccauccagccugagaaccucgaauaccggauuaugcugucgguccacggaucucaacacuccgguaugaucgugaaugauacgggccaugagaccgacgagaaccgagcuaaaguagaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgccggcgcagauacuggaacaccccauuggaacaauaaggaagcccuuguggaguuuaaagacgcucacgcgaagaggcagaccgucgugguccugggcucccaggagggggcagugcauaccgccuuggcuggagcccuagaagcagagauggauggugccaagggccggcugucuagcgggcaccucaaaugccgccugaagauggacaaacuuagacugaagggaguuucauauaguuuguguacugcugccuucacguuuacaaaaauaccugcagaaacccuccauggcacugugaccguagagguccaguacgcggguacagacgggccaugcaaggugcccgcucaaauggccguugauaugcagacccugacuccugugggcagguuaaucacagcaaacccagucauuacggaauccaccgagaacagcaagaugaugcuggagcuagaucccccguucggagacucuuacaucgugauaggcguaggggacaaaaagauuacucaccacugguaucguucaggaaguacaaucgguaaagccuuugaagcuaccgugcggggcgccaagcgaauggcaguucucggggauacagcuugggacuucggaagcgucggcggugcccugaauagccuugggaaaggcauccaucagauuuucggagcggccuuuaagucuuuguucggcgggaugucgugguuuagccaaauccugauuggaacucuccugguguggcuuggccugaacaccaagaaugguuccauaucauugacgugucucgcuuuagggggagugcugaucuuccugaguaccgcagucucugccgauguuggcugcagcguggacuuuuccaaa

SEQ ID NO: 1795 - RNA, 2136 nt, Artificial Sequence
  KX694533.2 prME-long CDS opt
agaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcaaagccaucucauuccccaccacauuggggguaaauaagugcuauauucagaucauggauuuaggacacaugugugacgcaacuaugaguuacgagugcccuaugcuggaugaaggcguggagccagacgaugucgacuguuggugcaacaccacaagcaccugggugguuuaugguacuugucaucacaaaaagggggaagccaggcggucccgcagagcugugacacuaccgucucauucgaccaggaagcuccaaacgcggucacagacuuggcuggagagccgcgaguacaccaaacaccuuauucgagucgaaaauuggaucuuuagaaaccccggauucgcacuggccgcugccgcgauagcaugguugcucggcaguuccacaucucagaaggugaucuaucugguaaugauucugcucaucgccccugcuuacagcauuaggugcaucggcguuuccaaucgggauuuuguggaggggaugucaggagguacuugggucgacgugguguuagaacauggcgggugugucaccguuauggcccaggauaaaccaacaguggacauagagcugguaaccacgacugugaguaacauggcagagguccguagcuacugcuaugaggcuucuauuuccgauauggccucagacagccgcugucccacacaaggagaagcguaccuugacaagcagagugauacccaguaugugugcaaaagaacuuugguugacaggggcugggguaauggguguggacuguucggcaagggcucucuagugacaugcgccaaguuugcaugcuccaaaaagaugaccgggaaaagcauccagccugaaaaccucgaguaccggauuaugcugucgguccacggaucucaacacuccgguaugaucgugaaugauaucggccaugaaacggacgagaaccgagcuaagguagagauuaccccaaauucaccccgcgccgaagcuacacuugggggauucggcagucuggguuuggauugugagccuagaacugggcucgacuuuagcgaucuguauuacuuaaccaugaacaauaaacacuggcugguucauaaggaaugguuccacgacauaccacucccguggcacgccggcgcagauacaggaacuccccauuggaacaauaaagaggcccuuguggaauuuaaggacgcucacgcgaagaggcagaccgucgugguccugggcucccaggagggggcagugcauacagccuuggcuggagcccuagaggcagaaauggauggugccaaaggccggcugucuagcgggcaccucaagugccgccugaaaauggacaagcugagacugaaaggaguuucauauaguuuguguaccgcugccuucacuuuuacgaagaucccugcagagacacuccauggcaccgugacuguagaaguccaguacgcggguaccgacgggccaugcaaggugcccgcucaaauggccguugauaugcagacacugaccccugugggcagguuaauuacugcaaacccagucaucacagaguccacggaaaacagcaaaaugaugcuggagcuagaucccccguucggagacucuuacauagugauuggcguaggggacaagaaaaucacccaccacuggcaucguucaggaaguacuaucgguaaggccuuugaggcuacagugcggggcgccaaacgaauggcaguucucggggauaccgcuugggacuucggaagcgucggcggugcccuuaauucccuugggaagggcauucaccagaucuucggagcggccuuuaagucuuuguucggcgggaugucgugguuuagccaaauucugauaggaacacuccugguguggcuuggccugaacacuaaaaaugguuccaucucauugaccugucucgcuuuagggggagugcugauuuuccugaguacggcagucucugccgauguuggcugcagcguggacuuuuccaag

SEQ ID NO: 1796 - RNA, 2136 nt, Artificial Sequence
  KY288905.1 prME-long CDS opt
agaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugauacaggccacgaaacugacgagaaccgagccaagguagagguuaccccuaauucaccacgcgcagaagcuacacuugggggauucggcagucuggguuuggauugugagcccagaacugggcucgacuuuagcgaucuguacuauuuaaccaugaacaauaaacauuggcuggugcacaaggaaugguuccacgacauuccucucccauggcaugccggcgcugauacaggaaccccgcacuggaacaauaaagaggcccuugucgaauuuaaggacgcacaugccaagaggcagacuguggucgugcugggcucccaggagggggcuguucacacggcguuggcaggagcccuagaggcugaaauggauggugccaaaggccggcuguucucugggcaucucaagugccgccugaaaauggacaaacuuagacugaagggagugagcuacucauuguguacagcagccuuuaccuucacuaagguacccgcugagacccuccacggcacagucaccguggaaguucaguaugccgguacugacgggccuugcaaggugccagcacaaauggcggucgauaugcagacacugacgcccgugggcagguuaauaaccgcuaacccuguaaucacugagaguacagaaaacuccaaaaugaugcuggagcuagacccacccuuuggagauagcuacauugugaucggcguuggggacaagaaaauaacccaccauuggcaccguucuggaucaacaauugguaaggccuucgaggcaacuguccggggcgccaaacgaauggcugugcucggggauaccgccugggacuucggaagugugggcggugucuuuaauagccuggggaagggcauccaucagaucuucggagcagcuuuuaagucccuuuucggcgggaugucuugguuuucgcaaauuuugaucggaacgcugcucguuuggcugggccuuaacaccaaaaaugguagcauuucccugacauguuuggcccucgggggagugaugauauuccugucaacugcggugagugccgauguaggcugcucugucgacuuuagcaag

SEQ ID NO: 1797 - RNA, 2136 nt, Artificial Sequence
  KF268950.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgauauaggccacgaaacggacgagaaucgagcuaaggucgaggugaccccuaacucaccacgcgccgaagcuacacuugggggauucggcagucuggguuuggauugugagcccagaacugggcucgacuuuagcgaucuguacuauuuaaccaugaauaacaaacauuggcugguacacaaggaaugguuccacgacaucccucucccauggcaugccggcgcagauacaggaacuccgcacuggaauaacaaagaggcccuuguugaauuuaaggacgcucaugcgaagaggcagaccguggucgugcugggcucccaggagggggcaguccacacagccuuggcuggagcccuagaggcagaaauggauggugccaaaggccggcuguucucugggcaucucaagugccgccugaaaauggacaaacuuagacugaagggagugagcuacucauuguguaccgcugccuuuacuuucacgaagguucccgcagagacacuccacggcaccgugacuguagaaguccaguaugcggguaccgacgggccuugcaaggugccagcucaaauggccguugauaugcagacacugacccccgugggcagguuaauuacugcaaacccugucaucacagagaguacggaaaauuccaaaaugaugcuggagcuagacccacccuuuggagauagcuacauagugauuggcguaggggacaagaaaaucacccaccauuggcaccguucuggaucaacuaucgguaaggccuucgaggcuacagugcggggcgccaaacgaauggcaguucucggggauaccgcuugggacuucggaagugucggcgguguguuuaacagccuggggaagggcgugcaucagauuuucggagccgcguuuaagucccuuuucggcgggaugucuugguuuucgcaaaucuugauuggaacacugcucgucuggcugggccuuaauacuaaaaacgguagcauaucccugaccuguuuggcccucgggggaguuaugaucuuccugucaacggcugugagugcagaugugggcugcucuguagacuuuagcaag

SEQ ID NO: 1798 - RNA, 2136 nt, Artificial Sequence
  KF383121.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauauaggccacgaaaccgacgagaaccgagcaaagguggagguaacaccuaauucaccacgcgcugaagccacucuugggggauucggcagucuggguuuggauugugagcccagaaccgggcucgacuuuagcgaucuguacuauuuaacaaugaacaauaaacauuggcugguucacaaggaaugguuccacgacaucccucucccauggcaugcuggcgccgauacuggaaccccgcacuggaacaauaaagaggcacuuguggaauuuaaggacgcccaugcuaagaggcagacagucgugguccugggcucccaggagggggcggugcacaccgcauuggccggagcucuagaggccgaaauggauggugcaaaaggccggcuguucucugggcaucucaagugccgccugaaaauggacaaacuuagacugaagggaguuagcuacucauuguguacugccgcuuuuacguucacaaaggugcccgccgagacccuccacggcacuguaaccgucgaagugcaguaugcagguacagacgggccuugcaagguuccagcgcaaauggcuguggauaugcagacccugacucccgucggcagguuaauuacagccaacccugugaucacggagaguaccgaaaacuccaaaaugaugcuggagcuagacccacccuuuggagauagcuacauaguaauuggcgugggggacaagaaaaucacucaccauuggcaccguucuggaucaacaaucgguaaggcauucgaggccaccguucggggcgcuaaacgaauggccguccucggggauacagcaugggacuucggaagugugggcgguguguuuaauagccuggggaagggcauucaucagaucuucggagcugccuuuaagucccuuuucggcgggaugucuugguuuucgcaaauuuugauaggaacucugcucgucuggcugggccuuaacaccaaaaaugguagcaucucccugacguguuuggcgcucgggggaguuaugauuuuccugucaaccgccgugagugcugaugugggcugcucuguagacuuuagcaag

SEQ ID NO: 1799 - RNA, 2118 nt, Artificial Sequence
  KF268949.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgaugaaaaucgagcuaaggucgaggugacgccuaacucaccacgcgccgaggcuacccuuggcggguucggaagucugggcuuggacugugaacccagaacaggucucgauuuuagcgaccuguacuauuuaacuaugaauaacaaacacuggcugguacauaaggagugguuccacgauauaccucucccauggcacgccggggcagacaccggcacaccgcauuggaauaacaaagaagcccuuguugaguuuaaggaugcucacgcgaagaggcagacuguggucgugcugggaucccaggaaggcgcaguccauaccgccuuggcuggggcccuagaggcagagauggacggagccaaaggucggcuguucucuggccaccucaagugccgccugaaaauggauaaacuuagacugaaaggggugagcuacucauuguguacagcugccuuuaccuucacuaagguucccgcagaaacgcuccauggaacagugaccguagagguccaguaugcgggcacugacgguccuugcaaggugccagcucaaauggccguugacaugcagacccugacacccguggggagguuaaucaccgcaaacccugucauuacugaaaguacagaaaauuccaaaaugaugcuggagcuagauccacccuuuggcgacagcuacaucgugauaggaguaggcgauaagaaaauuacgcaccacuggcaucguucugggucaaccaucggaaaggccuucgaggcuacugugcggggugccaaacgaauggcaguucucggcgacacagcuugggauuucgggagugucggaggcguguuuaacagccuggguaaggggauccaccagauuuucggcgccgcguuuaagucccuuuucggaggcaugucuugguuuucgcaaaucuugauugggacccugcucguguggcugggacuuaauacaaagaacggcagcauaucccugacuuguuuggcccucgguggggucaugaucuuccugucaaccgcuguuagugcagacgugggaugcucuguggauuuuagcaag

SEQ ID NO: 1800 - RNA, 2136 nt, Artificial Sequence
  KU955595.1 prME-long CDS opt
agaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugauaccggccacgaaacagacgagaaccgagcaaagguagagguuacuccuaauucaccacgcgcugaagccacccuugggggauucggcagucuggguuuggauugugagcccagaacagggcucgacuuuagcgaucuguacuauuuaacuaugaacaauaaacauuggcuggugcacaaggaaugguuccacgacauuccucucccauggcaugcuggcgccgauaccggaacaccgcacuggaacaauaaagaggcacuugucgaauuuaaggacgcccaugcuaagaggcagaccguggucgugcugggcucccaggagggggcgguucacacugcauuggccggagcucuagaggccgaaauggauggugcaaaaggccggcuguucucugggcaucucaagugccgccugaaaauggacaaacuuagacugaagggagugagcuacucauuguguacggccgcuuuuacauucaccaagguacccgccgagacucuccacggcaccgucacaguggaaguucaguaugcagguaccgacgggccuugcaaggugccagcgcaaauggcugucgauaugcagacucugacacccgugggcagguuaauaacggccaacccuguaaucaccgagaguacugaaaacuccaaaaugaugcuggagcuagacccacccuuuggagauagcuacauugugaucggcguuggggacaagaaaauaacacaccauuggcaccguucuggaucaaccauugguaaggcauucgaggccacaguccggggcgcuaaacgaauggccgugcucggggauacugcaugggacuucggaagugugggcggugucuuuaauagccuggggaagggcauccaucagaucuucggagcugccuuuaagucccuuuucggcgggaugucuugguuuucgcaaauuuugaucggaacccugcucguuuggcugggccuuaacacgaaaaaugguagcauuucccugaccuguuuggcgcucgggggagugaugauauuccugucaacagccgugagugcugauguaggcugcucugucgacuuuagcaag

SEQ ID NO: 1801 - RNA, 2136 nt, Artificial Sequence
  KF383116.1 prME-long CDS opt
agaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaacacaagaaaggggaagcacggcgcuccagaagggccgugacacuaccaucucauucgacccggaagcuccagacgcgcucacagacuuggcuggagagccgagaguauaccaagcaccuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacauggcgggugugucaccguuauggcccaagauaaaccuacaguggacauugagcugguaaccacgacugugaguaacauggcagagguccguagcuacugcuacgaggcuucuaucuccgauauggccucagacagccgcuguccaacacagggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucaacccgaaaaccucgaguaucggaucaugcugucgguccacggaucucagcacuccgguaugaucgugaaugauauuggccaugaaaccgacgagaaccgagcaaagguagagguuacaccuaauucaccacgcgcugaagccacucuugggggauucggcagucuggguuuggauugugagcccagaaccgggcucgacuuuagcgaucuguacuauuuaacaaugaacaauaaacacuggcuggugcauaaggaaugguuccacgacauaccucucccauggcacgcuggcgccgauacuggaaccccgcauuggaacaauaaagaggcacuugucgaauuuaaggacgcccacgcuaagaggcagacaguggucgugcugggcucccaggagggggcgguucauaccgcauuggccggagcucuagaggccgaaauggauggugcaaaaggccggcuguucucugggcaccucaagugccgccugaaaauggacaaacuuagacugaagggagugagcuacucauuguguacugccguaugcacggcugccaagguccccgcagagacacuccauggcaccgugacuguugaagugcaauaugcggguaccgacgggccuuguaaggucccagcucagauggccguggauaugcagacacugacccccguaggcagguuaaucacugcaaacccugugauuacagagaguacggaaaacuccaaaaugaugcuggagcuagacccacccuuuggagauagcuacaucguuauaggcgucggggacaagaaaauuacccaccacuggcaucguucuggaucaacuaucgguaaggccuucgaggcuacagugcggggcgccaaacgaauggcagugcucggggauaccgcuugggacuuuggaagugucggcgguguuuucaauagccuggggaagggcauccaccaaauuuucggagccgcguuuaagucccuuuucggcgggaugucuugguuuucgcagaucuugauuggaacacugcucguguggcugggccuuaacacuaaaaaugguagcauaucccugaccugcuuggcccucgggggagugaugaucuuccugucaacggcuguaagugcagaugucggcuguucuguggacuuuagcaag

SEQ ID NO: 1802 - RNA, 2118 nt, Artificial Sequence
  KU963574.2 prME-long CDS opt
agaaucauuaacgccaggaaggagcggaaacgccgaggcgcugacgcaagcauagggaucgugucccugcuccuuaccacagucauggccgcggaaauuacucguagaggaucugcuuacuauauguaccuggauaggucagacgccgguaaggcaaucaguuucguuacgaccuugggcgugaauaaaugccacguacagauuauggauuuagggcauaugugugacgccacaaugagcuaugagugccccaugcuggaugaaggaguggagccugacgaugucgacuguuggugcaacacuaccuccacaugggugguuuacggcaccugucaccauaagaaaggugaagcucggcgcucuagaagggcagugacucuaccaucgcacucaacacggaagcuccaaacccgcagccagacguggcuggagagucgagaguauacuaagcaucuuaucaaagucgaaaauuggauauuuagaaacccgggguucgcccugguggcuguagccaucgcgugguugcucggauccucuaccagccagaagguuauuuaccuggugaugauccugcucauugcacccgccuauuccaucaggugcauaggcgucucaaaucgggauuuuguggagggcaugagugggggaacauggguggacgucguuuuagaacacgguggcugugugacuguaauggcucaggauaaaccuaccguggacauugagcuggucacaaccacggugagcaacauggccgagguucguucuuacugcuacgaagcauccaucucagauauggcuagcgacagucgcuguccaacucaaggggaggccuaucuugacaagcagucugauacacaguacgugugcaaaagaaccuuggucgacaggggauggggcaaugguugugggcuguucggaaagggcucccuagugacuugcgcgaaguuuacaugcagcaaaaagaugaccggcaaaucgauucagcccgaaaaccucgaguaucggaucaugcugucuguacacgggucccaacauucaggaaugaucguuaaugaugaaaaccgagccaagguggaggucacgccuaauaguccacgcgcagaggcuacccuugguggcuucgggagccugggauuggacugugaacccagaacaggccucgauuuuuccgaccuguacuauuuaacuaugaacaauaaacacuggcuggugcauaaggagugguuccacgauauuccucucccauggcacucuggugccgacaccgaaacaccgcauuggaacaauaaagaggcucuugucgaauuuaaggaugcccacgcaaagaggcagacugugguugugcuggggagccaggagggcgccguacauaccgcuuuggcgggagcacuagaggccgaaauggacggcgcuaaagggcggcugucaaguggacaccucaagugccgccugaaaauggauaaacuuagacugaaaggugucuccuacagcuuguguacagccgcauucaccuuuacuaaggugcccgccgagacgcuccauggcacaguuaccguggaaguccaguaugcugggagggacggaccuugcaaggugccagcccaaauggcaguagacaugcagacucugacccccgugggccguuuaauaacagcgaacccuguuaucaccgagucuacugaaaacucaaaaaugaugcuggagcuagauccacccuucggugacaguuacauugucaucggggugggcgauaagaaaauaacacaccacuggcaucggagcggauccauuaucggcaaggcuuuugaggccacggugcgaggggcaaaaagaauggccguccucggagacaccgcuugggauuucgguucuguuggcgggguguucaauucgcugggaaagggcauccaccagauuuuuggugccgcauucaagagccuuuuugggggcauguccugguucucacaaaucuugauuggaacucugcucguguggcugggccuuaacacaaagaaugggaguauaucucugaccuguuuggcucucggaggcguaaugaucuuucugagcacagccgucuccgcggacguggguugcucaguugauuucagcaag

SEQ ID NO: 1803 - RNA, 2118 nt, Artificial Sequence
  KX601166.1 prME-long CDS opt
agaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugaugaaaaccgagcaaagguagagguuaccccuaauucaccacgcgcugaggccacacuuggcggguucggaagucugggcuuggacugugaacccagaacuggucucgauuuuagcgaccuguacuauuuaaccaugaacaauaaacacuggcuggugcauaaggagugguuccacgauauuccucucccauggcacgcuggggccgacacaggcacuccgcauuggaacaauaaagaagcacuugucgaguuuaaggaugcccacgcuaagaggcagaccguggucgugcugggaucccaggaaggcgcgguucauacagcauuggccggggcucuagaggccgagauggacggagcaaaaggucggcuguucucuggccaccucaagugccgccugaaaauggauaaacuuagacugaagggggugagcuacucauuguguaccgccgcuuuuacuuucacgaagguacccgccgaaacacuccauggaaccgucacuguggagguucaguaugcaggcaccgacgguccuugcaaggugccagcgcaaauggcugucgacaugcagacacugacccccguggggagguuaauaacugccaacccuguaaucacagaaaguacggagaacuccaaaaugaugcuggaacuagauccacccuuuggcgacagcuacauugugaucggaguuggcgauaagaaaauaacccaccacuggcaucguucugggucaacuauuggaaaggcauucgaggccacaguccggggugcuaaacgaauggccgugcucggcgacaccgcaugggauuucgggagugugggaggcgucuuuaauagccuggguaaggggauccaccagaucuucggcgcugccuuuaagucccuuuucggaggcaugucuugguuuucgcaaauuuugaucgggacacugcucguuuggcugggacuuaacacuaaaaauggcagcauuucccugaccuguuuggcgcucgguggggugaugauauuccugucaacggccgugagugcugacguaggaugcucugucgauuuuagcaag

SEQ ID NO: 1804 - RNA, 2136 nt, Artificial Sequence
  KF383118.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaaacacggcgcuccagaaggucugucucgcuacgguaucacuacacccgcaagcuccaaacgcgaucacagacuuggcuggagagcagagaguauaagaaacaucuuauaaugguggaaaauuggaucuuuaggaacccaggauucgcaauuguuaguguggccaucaccuggcugaugggcuccuugacaucucagaaggucauuuaccucgugaugaucguacugauaguuccggcuuacagcauuuccugcaucggcgugucaaaucgggaucuggucgaggggaugaguggagguacuuggguggacgugguccucgaacacggcggguguguuaccgagauggcccaggauaaacccacaguggacauugaguuaguaaccaugacggugagcaacauggcggaaguccguucuuauugcuacgaggcaucccugucagauauggccagcgcuagucgcuguccuacucaaggagaaccaucucuugacaagcaguccgacacacagagcgugugcaaaagaaccuugggcgauagggguugggggaauggauguggcaucuuuggcaaggggucgcugguuacuugcucuaaguucacaugcuguaaaaagaugcccggaaaauccauccagccugagaaccuagaauaucggauuaugcucccagugcacgguucacaacauaguggcaugauagucaaugacaucgggcacgagaccgaugagaaccgagccaagguggaaguaacgcccaauagcccucgcgcagaggcuacccugggaggcuuugguucccuugggcuggacugcgaaccaagaacaggcuuggauuucucugaccucuacuaucugacuaugaacaauaaacauugguuaguucacaaggagugguuucacgauauuccgcugcccuggcaugccggagcggacaccggcacaccucacuggaacaauaaagaagcccucguggaguucaaggaugcacaugcuaagaggcagacugucgugguccuugggagccaggagggagccgugcacaccgcucuggccggugcauuggaagccgagauggacggcgcuaaagggcggcuauuuucaggacaucugaagugucgccucaaaauggauaagcugagacuuaaaggcguuaguuacucccugugcacagcggcauucaccuuuacuaaggugccagccgaaacguugcacgguacaguaaccgucgaggugcagagcgcugggacugacggccccuguaagguuccugcccaaauggcaguggacaugcagacccucacaccagucggaaggcugaucaccgccaaccccgugauaacugaaucuacagagaacucaaaaaugauguuagagcuggauccgccuuucggcgacaguuauauuguaaucggggugggagauaagaaaaucacgcaccauuggcaccguagcgguuccaccauuggcaaggcuuuugaagccacuguucgaggggcaaaacggauggcgguccuaggagacacagcuugggauuucggcucugugggugggguguucaauucgcucggcaagggaauccaucagauuuuuggcgccgcauucaagagccuguuugggggaauguccugguucucacaaauacuuaucggcaccuugcuggucuggcucggucugaacacuaaaaaugggaguauuucucuuacaugccuggccuugggaggcguuaugaucuuucucagcaccgcuguguccgccgacguggguuguucaguagauuucagcaag

SEQ ID NO: 1805 - RNA, 2130 nt, Artificial Sequence
  KF383120.1 prME-long CDS opt
agaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacaaugggggugaauaaaugccacguccagaucauggauuugggacauaugugugacgcuacuaugaguuaugagugccccauguuagaugaaggcguugagccugacgauguggacuguuggugcaacaccacaagcaccuggguaguguacgguacuugucaccauaagaaaggggaagcacggccaucccgcagagccgucacacugccgucucacucgaccaggaagcuacaaacgcggucacagacuuggcucgagagccgcgaguauaccaagcaucugauaaaaguggaaaauuggauccuucgaaaccccggauuuacaguugcugcccuggcgauggcaugguugcucggcaauaguacuucccagagagugauuuaccuggucaugauccugcucauugccccugcuuauucuaucaggugcauaggcgugagcaaccgggauuucguagaggggauguccggagguaccuggguugacguggucuuagaacacggcgggugugugacagugauggcccaggauaagccaaccgucgacauugagcugguuacgacuacagugucaaauauggcagagguacguaguuacugcuacgaagcuagcaucucugauauggccuccgacucacgcugucccacccaaggagaggcguaucuugacaaacagagcgauacucaguacgugugcaagagaacauuggucgacaggggcugggguaacggguguggacuguuuggcaaaggcagucuagugaccugcgccaaguucacgugcucuaagaaaaugaccgggaaguccauucagccugaaaaucucgaguaucggaucaugcugagcguucacggaucgcaacauucugguaugaucgugaacgauauuggccacgaaacagacgagaaucgagcaaaagucgaggugacuccaaacucaccccgcgcugaagccacccuugggggauuuggcucccuggguuuggauugugagccuagaacagggcucgacuucagugaucuguacuauuuaacuaugaauaacaagcauuggcugguacacaaagaaugguuucacgacauaccacucccguggcaugcuggcgccgauaccggaacaccccacuggaauaacaaggaggcacuuguugaguucaaagacgcccaugcuaagaggcagaccguggucgugcugggcagccaggaaggggcgguccacacugcauuggccggagcucuagaggccgaaauggauggugcaaagggccggcuguuuuccgggcaucucaaaugccgcaucaagauggacaaacugagacuuaagggagugucuuacagccuguguacggccgcuuucacauuuucaaaaguuccugccgagaccuugcacggcacugugaccguagaaguccaguaugcagguagggacgggccaugcaaggugcccgcgcaaauggcuguugauaugcagacacucaccccugugggccgucugauuacugccaacccaaucauaacagagaguacggaaaauucccggaugauguuagagcuggaucccccguucggagacagcuacauugucaucggcgugggggacaagaaaaucacccaccauuggcaccgaucuggaucaacuauugguaaggcauuugaggccacaguaagaggcgcuaaaaggauggccgugcuaggggauaccgcaugggacuucggaaguguuggcggugucuucaacagccucgggaagggcgugcaucagguguuuggagcugccuucaaaucccuguuuggcgggaugucuugguucucgcaaauccuuauuggaacauugcuggucuggcucggccugaauacuaagaacgguagcauaucccuugcgugucuggcccucgggggagcuaugaucuuuuugucaaccgcaguuagugccgaugugggcugcucuguggacuuc

SEQ ID NO: 1806 - RNA, 2061 nt, Artificial Sequence; identical to SEQ ID NO: 1641
  KU321639.1 prME-short CDS opt

SEQ ID NO: 1807 - RNA, 2061 nt, Artificial Sequence; identical to SEQ ID NO: 1642
  KU312312.1 prME-short CDS opt

SEQ ID NO: 1808 - RNA, 2049 nt, Artificial Sequence; identical to SEQ ID NO: 1643
  AY632535.2 prME-short CDS opt

SEQ ID NO: 1809 - RNA, 2061 nt, Artificial Sequence; identical to SEQ ID NO: 1644
  KU527068.1 prME-short CDS opt

SEQ ID NO: 1810 - RNA, 2061 nt, Artificial Sequence
  KX421193.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaccgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugcc

SEQ ID NO: 1811 - RNA, 2061 nt, Artificial Sequence
  KX377335.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccgcaagaaaggugaggcccgacguuccagaagggcugucacacuaccaucucauucgacccggaagcuccaaacgcgcucacagacuuggcuggaaagcagagaguauaccaaacaccuuauuaagguggagaacuggaucuuuaggaauccgggguucgcacugguugccguggcuauagccugguugcucggaaguuccacaucucagaaggucaucuaccuggugaugauucugcucaucgcgcccgcauauagcauucggugcaucggcguauccaaccgcgacuuuguugaaggcaugucagggggaacuuggguggaugucguguuagagcaugguggcugugugaccgucauggcccaggacaaaccuacaguugauauagaacuggugaccacgacuguaaguaauauggcugaggugcgaagcuacugcuacgaggccucuauuuccgacauggcaucagauagcagauguccaacacaaggggaggcuuaucuugacaagcagagugacacccaguacgucugcaaaaggacuuugguggaucggggauggggcaacgguugugggcuguucggaaagggcucucuaguuacaugcgccaaauuuaccugcuccaagaagaugacgggcaaaagcauccagcccgaaaaucucgaauaucguauuaugcugucggugcacgggucucaacacuccggaaugaucgucaacgacaccgguuacgagacagaugaaaaucgcgcgaagguggagguaacuccuaacucaccaagagccgaggcaacccuuggcggguucggaagucugggcuuggacugugaacccaggacaggucucgauuuuagcgaccuguauuacuuaacuaugaauaacaaacauuggcugguucacaaggagugguuccaugauaucccucucccauggcacgcuggggccgacaccggcacaccgcacuggaauaacaaagaagcucuuguggaguuuaaggaugcccaugcaaaacggcagaccgucgugguccugggaucccaggaaggcgccgugcacacugcuuuggcgggggcacuagaggccgagauggacggagcuaaggguaagcuguucucuggccaucucaaaugccgacugaagauggauaaacuucgccugaaggggguuagcuauucauuguguacggccgcauuuacauucaccaaagugcccgccgaaacucuccacggaaccguaacagucgaggugcaguacgcuggcaccgacgguccuugcaagauuccaguucaaauggccguggacaugcagacucugacacccgucgggagauuaauaacggcaaauccugugaucaccgaaaguacugagaacuccaagaugaugcuggaacuagauccacccuuuggcgacagcuacauuguaaucggagugggcgauaaaaagauaacacaucacuggcacaggucugggucaaccauuggaaaagcguucgaggcuacaguucggggugccaagcgcauggcaguccucggcgacacugccugggauuucgggagugugggaggcguguuuaacagccuggguaaagggauccaucagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugcc

SEQ ID NO: 1812 - RNA, 2061 nt, Artificial Sequence
  LC002520.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaccgucaacgacaucgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugcc

SEQ ID NO: 1813 - RNA, 2043 nt, Artificial Sequence
  DQ859059.1 prME-short CDS opt
accagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacgagaaucgugccaagguagaaguuacaccuaacucaccacgcgcggaggccacucuugguggcuucgggagucugggauuggauugugagcccagaaccggccucgacuuuagcgaucuguacuauuuaacaaugaauaacaaacacuggcuggugcauaaggaaugguuccacgacaucccucucccauggcacgcaggggcugauacugggaccccgcauuggaauaacaaagaggcccuugucgaauuuaaggacgcucacgccaaaaggcagacaguggucgugcugggcucccaggagggagcaguucauaccgccuuggcuggcgcgcuagaagcagagauggauggggccaagggacggcuguucucuggucaccucaagugccgacugaaaauggacaaacuucgccugaagggcgugagcuacucauuguguacugcugccuuuacguucacaaagguacccgcagagacccuccaugggacugucaccguggaaguucaguaugccggaacagauggcccuugcaaagugccagcucaaauggccgucgacaugcagacccugacucccguggguagauuaaucacagcaaauccuguaauuacggagaguaccgaaaacuccaagaugaugcuggagcuagacccacccuuuggggauagcuacauagugaucggcguuggagacaagaaaauuacucaccacuggcauaggucuggcucaacaaucgggaaggcguucgaagcuaccguccggggagccaaacgcauggcagugcucggugauacagccugggacuucggcaguguggguggagucuuuaacagccugggcaaggguauacaccagauuuucggggcugccuuuaaaucccuuuucggcggaaugucuugguuuucgcaaaucuugaucggcacucugcucguuuggcuggggcuuaauaccaagaacggaagcauuucccugacguguuuggcacucggcggugugaugaucuuccugucaaccgcugugagugcc

SEQ ID NO: 1814 - RNA, 2049 nt, Artificial Sequence
  KU963573.2 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgagaaucucgaauaucggauuaugcugucggugcacgggucucaacauuccggaaugaucgguuacgagaccgacgaaaaccgugcgaaggucgaggugacaccuaauucaccacgcgccgaggcaacucuuggcggguucggaagucugggcuuggauugugaacccagaaccggucucgacuuuagcgaucuguauuacuuaacaaugaacaauaaacacuggcugguacauaaggagugguuccacgacaucccucucccauggcacgcuggggccgauacuggcaccccgcauuggaacaauaaagaagcucuuguugaguuuaaggacgcccacgcaaaaaggcagacaguggucgugcugggaucccaggaaggcgccguccauaccgcuuuggcgggggcacuagaggccgagauggauggagcuaaggguaagcuguucucuggccaccucaaaugccggcugaagauggacaaacuucgacugaagggggugagcuauucauuguguacugccgcauuuacguucacaaaaguucccgccgaaacccuccauggaacugugaccguagagguccaguacgcuggcacagaugguccuugcaagauuccagugcaaauggccguugacaugcagacccugacucccguggggcgcuuaauaacagcaaacccugucaucacggaaaguaccgaaaauuccaagaugaugcuggaacuagacccacccuuuggcgauagcuacauugugaucggaguaggcgacaaaaagauaacucaccacuggcauagaucugggucaacaauuggaaaagcguucgaggcuaccgugaggggugccaagcggauggcaguucucggcgauacagccugggacuucgggagugucggaggcguguuuaacagccuggguaaagggauccaccagaucuucggcgcugccuuuaagucccuuuucggaggcaugucuugguuuucgcaaauuuugaucgggacucugcucguguggcugggacuuaacaccaagaauggcagcauuucccugacguguuuggcacucgguggggucaugauauuccugucaaccgcuguuagugcc

SEQ ID NO: 1815 - RNA, 2061 nt, Artificial Sequence
  KX694534.2 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguagggggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugca

SEQ ID NO: 1816 - RNA, 2061 nt, Artificial Sequence
  KX369547.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccgggcuggcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggagucggcgagaaaaagaucacucaccacuggcaucggucugggucaacaauaggaaaggcauucgaagccaccgugcgcggugcuaaaagaauggccguacugggcgauacagcaugggacuuugggagugugggaggcgcucuuaauagcuuggguaaggggauucaccagaucuucggcgccgcguucaaaucccuguuuggaggcaugucuugguucucgcaaauccucauugggacucugcuuauguggcugggauugaacaccaagaauggcagcaucucccucaugugucuggccuuaggugggguucugauuuuucuaucaacggcugucagugca

SEQ ID NO: 1817 - RNA, 2061 nt, Artificial Sequence
  KX447515.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacugguaucggucugggucaacaauaggaaaggcauuugaagccaccgugcgcggugcuaaaagaauggccguacucggcgauacagcaugggacuucgggagugugggaggcgcucugaauagccuugguaaggggauucaucagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugca

SEQ ID NO: 1818 - RNA, 2061 nt, Artificial Sequence
  KU729218.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacacccagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugca

SEQ ID NO: 1819 - RNA, 2061 nt, Artificial Sequence
  KU501217.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagauccgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugca

SEQ ID NO: 1820 - RNA, 2061 nt, Artificial Sequence
  KU312314.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacuggcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugca

SEQ ID NO: 1821 - RNA, 2061 nt, Artificial Sequence
  KX446950.2 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuacccuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugca

SEQ ID NO: 1822 - RNA, 2061 nt, Artificial Sequence
  KY003157.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggucgugagugcu

SEQ ID NO: 1823 - RNA, 2061 nt, Artificial Sequence
  KX811222.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaagugcauggguggucuauggcaccugucaucacaaaaagggugaagcccgccgaagccguagagcugugacucuaccgucccauucuacaaggaaacuccaaacccggccccagacguggcuggagucgcgcgaguacacuaagcaccuuauuagaguugaaaauuggaucuuuaggaacccuggguucgcacuggccgcugccgcgauugcaugguugcucggaucaagcaccagucagaaagugaucuaucuggucaugauacugcucaucgccccagcuuacuccauucggugcaucggcgugucuaaucgcgacuuuguagagggcaugagcgggggaacauggguugauguggucuuagaacaugguggcugugugacugugauggcccaggacaagcccaccgucgauauugagcugguuacaaccacgguguccaacauggcagagguacgaucauacugcuaugaagcuaguaucagcgacauggccucugauuccagauguccuacucaaggggaggcguaccuugacaagcagucagacacacaguaugugugcaaaaggaccuuggucgaucggggauggggcaaugguugugggcuguucggaaagggcagccuagugacuugcgccaaauuugcaugcaguaagaaaaugacaggcaagucuauacagccagaaaaccucgaguaccguauuaugcuguccguucacgggagccaacacucgggaaugaucgugaaugacaccggucaugaaacggaugagaaccgcgcuaaggucgagauuacccccaauucuccuagagccgaagcuacacuuggcggguucggaucccugggcuuggacugugagccaaggacuggucucgauuuuucagaccuguauuacuuaaccaugaacaauaaacacuggcuggugcauaaggaaugguuccacgauaucccgcuccccuggcacgccggggcagacacaggcacuccucauuggaacaauaaagaggcccuuguagaauuuaaggaugcucacgcgaaacggcagaccguugugguccugggaagucaggagggcgcagugcauacagccuuggcuggggcccuagaggcagaaauggacggagccaagggucgacugagcuccggccaccucaaaugccgccugaagauggauaaacuuagacugaaaggggucucuuauagcuuguguaccgcugccuucacuuuuacgaagaucccagcagagacacuccauggaaccgugacuguugaagugcaguacgcgggcaccgacggucccugcaaaguaccugcucaaauggccgucgacaugcagacacugaccccaguggggagguuaauuacugcaaaccccguuauaacagagucaacggaaaacaguaagaugaugcuggagcuagauccgccuuucggcgacuccuacaucgugauuggagucggcgagaaaaagaucacccaccacuggcaucggagcgggucuacuauaggaaaggccuuugaagcuacagugcgcggugccaaaagaauggcaguacucggcgauaccgcuugggacuucgggucagugggaggcgcccugaauagucuugguaaggggauucaccagaucuucggcgcggccuuuaagagcuuguucggaggcauguccugguuuucucaaauccugauugggacacuccugauguggcuuggacugaacacuaagaauggcucgaucagcuugaugugucucgcucugggugggguuuuaauuuuccuguccaccgcagucucagcc

SEQ ID NO: 1824 - RNA, 2061 nt, Artificial Sequence
  KX447516.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacauccaaaaaggugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacagggggaggccuaccuugacaaacaaagcgacacccaguaugugugcaagaggacuuuggucgaucggggauggggcaaugguugugggcuguucggaaaaggcagucuagugacaugcgcgaaguuugccugcucuaaaaagaugaccggcaaguccauacagccugaaaaccucgaguaccguauuaugcugagcguucacgggucgcagcacucuggaaugaucgugaaugacacgggucaugaaaccgaugagaaccgcgcaaaagucgagauuacaccaaauucccccagagcugaagccacucuuggcggguucggaucacugggcuuggacugugagccuaggaccggucucgauuuuagugaccuguauuacuuaacaaugaacaauaagcacuggcuggugcauaaagaaugguuccacgauaucccacucccguggcacgcuggggccgacacuggcaccccucauuggaacaauaaggaggcacuuguagaauuuaaagaugcccacgcuaagcggcaaacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcagauggcugucgacaugcaaacccugacuccuguggggagguuaauuacagccaacccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaauagccuugguaaagggauucaccagaucuucggcgccgcguuuaaguccuuguucggaggcaugucuugguuuucgcagauccugauugggacucuccugauguggcuuggacugaacaccaaaaauggcagcaucuccuugaugugucucgcccugggugggguuuuaauuuuccugucaacggcugucagugca

SEQ ID NO: 1825 - RNA, 2061 nt, Artificial Sequence
  KX520666.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacacggcagaaagugaucuaucuggucaugauacugcucaucgcacccgccuacuccauucgcugcaucggcgugucuaaucgagacuuuguagagggcaugagcgggggaacuuggguugauguggucuuagaacaugguggcugugugaccgugauggcucaggacaagccaacagucgauauugagcugguuaccacgacuguguccaacauggccgagguaagaucauacugcuaugaagcaaguaucagcgacauggcuucugauuccaggugucccacacaaggggaggccuaccuugacaagcagucagacacccaguaugugugcaaacggacuuuggucgaucguggauggggcaaugguugugggcuguucggaaagggcagccuagugacaugcgcgaaauuugccugcaguaagaaaaugaccggcaagucuauacagccugaaaaccucgaguaccgcauuaugcuguccguucacgggagccaacacucgggaaugaucgugaaugacacgggucaugaaaccgaugagaacagagcaaaggucgagauuacaccaaauucucccagggcugaagccacucuuggcggguucggaucccugggcuuggacugugagccucggaccggucucgauuuuucagaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacgacagacaguugugguccugggaagucaggagggcgcggugcauaccgcauuggccggggcucuagaggccgaaauggacggagcaaagggucgccugagcuccggccaccucaaaugcagacugaagauggauaaacuuaggcugaaaggggucucuuauagcuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggcgguuaauuacagccaacccaguuauaacggagucaaccgaaaacaguaagaugaugcuggagcuagaucccccguucggcgacuccuacaucgugauuggagucggcgagaaaaagaucacucaccacuggcaucgcagcgggucuacaauaggaaaggcauuugaagccaccgugagaggugcuaaaaggauggccguacucggcgauacagcaugggacuucgggucagugggaggcgcucugaauagucuugguaaggggauucaccagaucuucggcgccgcguuuaagagcuuguucggaggcauguccugguuuucucaaauccugauugggacucuccugauguggcuuggacugaacaccaagaauggcucgaucagcuugaugugucucgcccugggugggguuuuaauuuuccuguccacggcugucucagca

SEQ ID NO: 1826 - RNA, 2061 nt, Artificial Sequence
  KU497555.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaacccaggagggcgcggugcauacugcauuggccggggcucuagaggccgaaauggacggagcaaagggucgacugagcuccggccaccucaaaugccgccugaagauggauaaacuuagacugaaaggggucucuuauagcuuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagucaacugaaaacaguaagaugaugcuggagcuagaucccccguucggcgacuccuacaucgugauuggagucggcgagaaaaagaucacacaccacuggcaucggagcgggucuaccauaggaaaggcauuugaagccacagugcgcggugcuaaaagaauggccguacucggcgauacugcaugggacuucgggucagugggaggcgcucugaauagucuugguaaggggauucaccagaucuucggcgccgcguuuaagagcuuguucggaggcauguccugguuuucucaaauccugauugggacccuccugauguggcuuggacugaacacgaagaauggcucgaucagcuugaugugucucgcccugggugggguuuuaauuuuccuguccaccgcugucucagca

SEQ ID NO: 1827 - RNA, 2061 nt, Artificial Sequence
  KY075939.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuuuacggugcauuggcgugagcaaucgcgacuuuguagagggcauguccgggggaacuuggguugaugugguccuggaacaugguggcugugugaccgugauggcucaggacaagccaacagucgauaucgagcuuguuaccacgacugugucaaacauggccgagguacgaaguuacugcuaugaagcaagcauuucugacauggcuuccgauucaagaugucccacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauccagccugaaaaccuggaguaccguauaaugcuuagcguucacgggucgcaacacucuggaaugauugugaaugacacgggucaugaaaccgaugagaaccgcgcaaaggucgagaucacaccaaauucccccagagcugaagccacucugggcggguucggaucauugggccucgacugugagccuaggaccggucuggauuuuagugacuuauauuaccugacaaugaacaauaaacacuggcucgugcauaaggaaugguuccacgauauuccacuuccguggcacgcuggggccgacacuggcaccccucauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagaucccugccgagacccugcauggaacugugaccguugaagugcaguacgcaggcacagacgguccaugcaaaguacccgcgcaaauggcugucgacaugcagaccuuaacuccuguggggaggcugaucacagccaacccaguuauuacggagaguaccgaaaacuccaagaugaugcuagagcucgaucccccguucggcgacagcuacauagugaucggagucggcgagaaaaagauuacucaccacuggcaucggucugggucaacaaucggaaaggcauuugaagccaccgugcgcggugcuaaaagaauggccguacugggcgauacagcaugggacuucgggagugugggaggcgcucuuaauagcuuggguaaggggauacaccagauuuucggcgccgcguuuaaaucccuguucggaggcaugucuugguuuucgcaaauccucaucgggacucugcuuauguggcugggauugaacaccaagaauggcagcauuucccucaugugucuggccuuaggugggguucugaucuuccuaucaacggcugucagugca

SEQ ID NO: 1828 - RNA, 2061 nt, Artificial Sequence
  KY075932.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaaucgaaaauuggauuuuuaggaaccccggguucgcucuggcagccgcugccaucgcgugguugcucggaagcaguacaucccagaaaguuauauaucuggugaugauccugcucauugcacccgccuacucuauccggugcauuggcgucagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugca

SEQ ID NO: 1829 - RNA, 2061 nt, Artificial Sequence
  KU870645.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauccugaggaaccccggguuugcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggaaucggcgagaaaaagauaacucaccacuggcaucggucugggucaacaauuggaaaggcauucgaagccaccguccgcggugcuaaaagaauggccgugcugggcgauacagcaugggacuuugggaguguaggaggcgcucuuaauagcuuggguaaggggauccaccagaucuucggcgccgcguucaaaucccuguuuggaggcaugucuugguucucgcaaauucucaucgggacucugcuuauguggcugggauugaacaccaagaauggcagcauuucccucaugugucuggccuuagguggggugcugauauuucuaucaacggcuguuagugca

SEQ ID NO: 1830 - RNA, 2061 nt, Artificial Sequence
  KU729217.2 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuucaaccacggugaguaacauggccgagguacgaagcuacugcuaugaagcaacuaucucugacauagcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacagcgguugugcugggaagccaggagggcgcaguccauaccgccuuggcuggggcccuagaggcagaaauggacggagccaagggucgacuguccucuggccaccucaaaugccgccugaagauggauaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagacaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugcc

SEQ ID NO: 1831 - RNA, 2061 nt, Artificial Sequence
  KX087101.3 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaacugcaguacgcaggcacagacgguccaugcaaagugcccgcgcaaauggcuguagacaugcagaccuuaacuccugucgggaggcugauuacagccaacccagugauaacggagaguaccgaaaacuccaagaugaugcuagagcucgaucccccguucggcgacagcuacaucguuauuggagugggcgagaaaaagaucacucaccacuggcaucggucugggucaacaauaggaaaggcauuugaagccaccguccgcggugcuaaaagaauggccgugcugggcgauacagcaugggacuucgggaguguaggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuagguggggugcugauuuuccuaucaacggcuguuagugca

SEQ ID NO: 1832 - RNA, 2061 nt, Artificial Sequence
  KY014317.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaucgaaaacuccaagaugaugcuggagcuagaucccccguucggcgacagcuacauugugaucggagucggcgagaaaaagauaacccaccacuggcaucggucugggucaacuauuggaaaggcauuugaagccacagugcgcggugcuaaaagaauggccguacucggcgauaccgcaugggacuucgggagugugggaggcgcucugaauagccuugguaaggggauccaccagaucuucggcgccgcguuuaaauccuuguucggaggcaugucuugguuuucgcaaauucugaucgggacacuccugauguggcuuggacugaacacuaagaauggcagcauuuccuugaugugucucgcccugggugggguuuuaauauuccugucaaccgcugucagugca

SEQ ID NO: 1833 - RNA, 2061 nt, Artificial Sequence
  KU758876.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagucaagggucgacuguccucuggccaccucaaaugccgccugaagauggauaaguuaagacugaaaggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuucauguguuuggcgcucggugggguccugauuuuucuuucaacggccgugagugcu

SEQ ID NO: 1834 - RNA, 2061 nt, Artificial Sequence
  KU758874.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaaggguaaacuguccucuggccaccucaagugccgacugaagauggauaaacuucgccugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagauuaauuacagccaacccaguuauaacggagaguaccgaaaacuccaaaaugaugcuggagcuagaucccccguucggcgacagcuacaucgugauuggagucggcgagaagaagaucacucaccacuggcauaggucugggucaacaauaggaaaagcauuugaagccaccgugcggggugcuaagcgcauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugca

SEQ ID NO: 1835 - RNA, 2061 nt, Artificial Sequence
  KY317939.1 prME-short CDS opt
accagcgugggcaucgucgggcugcuccuuacaacugccauggcugcagagguuacgagaaggggauccgccuacuauauguaccuggaccggaaggaugcgggugaagcuauuucuuuccccaccacauugggcaugaacaaaugcuauauacagaucauggacuuagggcacaugugugaugccacuaugucauacgagugcccuaugcuggacgaaggaguggagccagaugacguagauuguuggugcaauaccacaaguaccuggguggucuauggcacuugucaucacaagaaaggugaagcacgccgaagccguagagccgugacacuaccgucccauucuaccaggaagcuccaaacgcggucgcagacuuggcuggagucacgcgaguacaccaaacaccuuauuagaguugaaaacuggaucuuuaggaaucccggguucgcucuggcagccgcugccauugcgugguugcucggaagcaguacaucccagaaggugaucuaucuggucaugauacugcucaucgcacccgccuacucuauucggugcaucggcgugagcaaccgcgacuuuguagagggcauguccgggggaacuuggguugauguggucuuagaacaugguggcugugugaccgugauggcucaggacaagccaacagucgauauugagcugguuaccacgacugugucaaauauggccgagguacgaaguuacugcuaugaagcaagcaucucugacauggcuuccgauucaagaugucccacacaaggggaggccuaccuugacaaacagagcgacacccaguaugugugcaagaggacuuuggucgaucggggauggggcaacgguugugggcuguucggaaaaggcagucuagugacaugcgcgaaguuugccugcucuaaaaagaugaccggcaaguccauacagccugaaaaucucgaguaccguauuaugcugagcguucacgggucgcaacacucuggaaugaucgugaacgacacgggucaugaaaccgaugagaaucgcgcaaaagucgagauuacaccaaacucccccagagcugaagccacucuuggcggguucggaucacugggcuuggacugugagccuaggaccggucucgauuuuagugaccuguauuacuuaacaaugaauaacaagcacuggcuggugcauaaagaaugguuccacgauaucccacucccguggcacgcuggggccgacacuggcaccccucauuggaauaacaaggaggcacuuguagaauuuaaagaugcccacgcuaagcggcagacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagguuaauuacagccaauccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaacagccuugguaaagggauucaccagaucuucggcgccgcguuuaaguccuuguucggaggcaugucuugguuuucgcaaauccugauugggacucuccugauguggcuuggacugaauaccaaaaacggcagcaucuccuugaugugucucgcccugggugggguuuuaauuuuccugucaacggcugucagugca

SEQ ID NO: 1836 - RNA, 2061 nt, Artificial Sequence
  KY014314.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaggcccacgcuaaacggcagacaguugugguccugggaagccaggagggcgcggugcauaccgcauuggccggggcucuagaagccgagauggauggagcaaagggucgacuguccucuggccaccucaaaugccgccugaagauggacaaacuuagacugaaaggggucagcuauucauuguguacugccgcuuucacguuuacaaagaucccugccgaaacccuccauggaacugugaccguugaggugcaguacgcaggcacagaugguccaugcaaaguacccgcgcaaauggcugucgacaugcagacccugacuccuguggggagguuaauuacagccaacccaguuauaacggaaaguaccgagaacuccaagaugaugcuggagcuagaucccccguucggcgacagcuacaucgugauuggagucggcgaaaagaagaucacucaccacuggcaucggucugggucaacaauaggaaaggcauuugaggccaccgugcgcggugcuaaaagaauggccguacucggcgacacagcaugggauuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugca

SEQ ID NO: 1837 - RNA, 2061 nt, Artificial Sequence
  KX447517.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgccccugcauacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccgcucuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaacacugaucgggacucuccugauguggcuuggacugaacaccaagaauggcagcauuuccuugaugugucucgcucugggugggguuuuaaucuuccugucaacggcagucagugcc

SEQ ID NO: 1838 - RNA, 2061 nt, Artificial Sequence
  KU926310.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcgcggacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugcc

SEQ ID NO: 1839 - RNA, 2061 nt, Artificial Sequence
  KU922923.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcauuagccuacucuauucggugcaucggcgugagcaaucgcgacuuuguagagggcauguccgggggaacuuggguugaugugguccuggaacaugguggcugugugaccgugauggcucaggacaagccuacagucgauauugagcuuguuaccacgacugugucaaacauggccgagguacgaaguuacugcuaugaagcaagcaucucugacauggcuuccgauucaagauguccaacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauacagcccgaaaaccuggaguaccguauuaugcuuagcguucacgggucgcaacacucuggaaugaucgugaaugacacgggucaugaaaccgaugagaaccgcgcaaaggucgagauuacaccuaauuccccaagagcugaagccacucugggcggguucggaucauugggccucgacugugagcccaggaccggucuggauuuuagugacuuauauuaccugacaaugaacaauaaacacuggcucgugcauaaggaaugguuccacgauaucccucuuccauggcacgcuggggccgacacuggcaccccgcauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagauccccgccgagacccugcauggaacugugaccguugaagugcaguacgcaggcacagacgguccuugcaaaguaccagcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugca

SEQ ID NO: 1840 - RNA, 2061 nt, Artificial Sequence
  KY075937.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacaugguguccgauucaagaugucccacacaaggggaggcuuaccuugacaagcagagcgacacccaguaugucugcaaaaggacuuugguggaucggggauggggcaaugguugugggcuguucggaaagggcagucuaguuacaugcgccaaauuugcgugcucuaagaaaaugaccggcaaguccauacagccugaaaaccucgaguaccguauuaugcugagcgugcacgggucgcaacacucuggaaugaucgucaaugacacgggucaugaaaccgaugagaaccgcgccaagguggagauuacaccaaauucccccagagcagaagcuacucuuggcggguucggaucacugggcuuggacugugagccuaggaccggucucgauuuuagugaccuguauuacuuaacaaugaacaauaaacacuggcugguacauaaggaaugguuccacgauaucccacucccguggcacgccggggcugacacuggcaccccucauuggaacaauaaagaggcccuuguugaauuuaaggaugcacacgccaaacggcagacaguggucgugcugggaagccaggagggcgcuguccauaccgcguuggcaggggcccuagaggcugaaauggacggagccaagggucgacuguccucuggccaccucaaaugccgccugaagauggauaaacuuagacugaagggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuugaugugucucgcgcuggguggggucuuaauuuuccugucaacggccgugagugcu

SEQ ID NO: 1841 - RNA, 2061 nt, Artificial Sequence
  KY003156.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcauuagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaauccugggcuuggacugugagccuaggaccggucucgauuuuucagaccuguauuacuuaacaaugaacaauaaacacuggcugguccauaaggaaugguuccacgauauuccacucccguggcacgcuggggccgacacuggcaccccucauuggaacaauaaagaggcacuuguggaauuuaaggaugcccacgcuaaacggcagacaguaguugugcugggaagucaggagggcgcgguccauaccgcauuggccggggcucuagaggccgaaauggacggagcaaagggucgacugagcuccggccaccucaaaugccgccugaagauggauaaacuuagacugaaaggggugucuuauagcuuguguacugccgcuuucacguuuacaaagauaccugccgagacccuccauggaacugucaccguggaaguucaguacgcaggcacagacgguccaugcaaagugcccgcgcaaauggcuguagacaugcagacccugacuccugucgggagguuaaucacagccaacccagugauuacggagucaaccgaaaacaguaagaugaugcuggagcuagaucccccguucggcgacuccuacaucguuauaggagugggcgagaaaaagauuacucaccacuggcaucggagcgggucuacaaucggaaaggcauuugaagccaccguccgcggugcuaaaagaauggccgugcucggcgauacagcaugggacuucgggucaguaggaggcgcucugaauagucuugguaaggggauccaccagauuuucggcgccgcguuuaagagcuuguucggaggcauguccugguuuucucaaauccugauugggacucuccugauguggcuuggacugaacaccaagaauggcucgaucagcuugaugugucucgcccugggugggguguuaauauuccuguccacggcuguuucagca

SEQ ID NO: 1842 - RNA, 2061 nt, Artificial Sequence
  KU312313.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuauuaggaaacuccaaacgcggucgcagacuuggcuggagucacgcgaguacaccaagcaccuuaucagaguugaaaauuggauuuuuaggaaccccggguucgcucuggcagccgcugccaucgcgugguugcucggaagcaguacaucccagaaagugauauaucuggucaugauccugcucauugcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauaucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagauuccugccgagacccuccauggaacugugaccguugaagugcaguacgcaggcacagacgguccaugcaaaguacccgcgcaaauggcugucgacaugcagacccugacuccuguggggagguuaauaacagccaacccaguuaucacggagaguaccgaaaacuccaagaugaugcuggagcuagaucccccguucggcgacagcuacauugugaucggagucggcgagaaaaagauaacucaccacuggcaucggucugggucaacaauuggaaaggcauuugaagccaccgugcgcggugcuaaaagaauggccguacucggcgauacagcaugggacuucgggagugugggaggcgcucugaauagccuugguaaggggauccaccagaucuucggcgccgcguuuaaauccuuguucggaggcaugucuugguuuucgcaaauucugaucgggacucuccugauguggcuuggacugaacgccaagaauggcagcauuuccuugaugugucucgcucugggugggguuuuaauauuccugucaaccgcagucagugcc

SEQ ID NO: 1843 - RNA, 2061 nt, Artificial Sequence
  KY075935.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacaacgcagccgacgugccgugacacuaccgucccauucuaccagaaaacuccagacgaggucgcagacuuggcuggagucacgggaguacaccaagcaccuuauucgcguugaaaauuggaucuuuagaaaccccggguucgcucuggcagccgcugccauugcgugguugcucggaagcaguacaucccagaaagugaucuaucuggucaugauacugcucaucgcacccgccuacucuauuaggugcaucggcgugagcaaucgggacuuuguagagggcauguccgggggaacuuggguugauguggucuuagaacaugguggcugugugaccgugauggcucaagacaagccaacagucgauauugagcugguuaccacgacugugucaaacauggccgagguacgcaguuacugcuaugaagcaagcaucucugacauggcuuccgauucacgaugucccacacagggggaggccuaccuugacaagcagagcgacacccaguaugugugcaaaagaacuuuggucgauaggggauggggcaaugguugugggcuguucggaaagggcagucuagugacaugcgcgaaauuugccugcucuaagaaaaugaccggcaaguccauacaaccugaaaaccucgaguaccggauuaugcugagcguucacgggucgcagcacucuggaaugaucgugaaugacacgggucaugaaaccgaugagaaccgugcaaaggucgagauuacaccaaauuccccucgcgcugaagccacucuuggcggguucggaucacugggcuuggacugugagccuagaaccggucucgauuuuagugaccuguauuacuuaacaaugaacaauaaacacuggcuggugcauaaggaaugguuccacgauaucccacucccguggcacgcuggggccgacacuggcacaccccauuggaacaauaaagaggcacuuguagaauuuaaggaugcccacgcuaaaaggcagaccguugugguccugggaagccaggagggcgcggugcauaccgcauuggccggggcucuagaggccgaaauggacggagcaaagggucggcuguccucuggccaccucaaaugccgacugaagauggauaaacuucgccugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagauuaauuacagccaacccaguuauaacggagaguaccgaaaacuccaagaugaugcuggagcuagaucccccguucggcgacagcuacaucgugauuggagucggcgagaaaaagaucacucaccacuggcauaggucugggucaacaauaggaaaggcauuugaagccaccgugcggggugcuaaacgcauggccguacucggcgauacagcaugggacuucgggagugugggaggcgcucugaauagccuugguaaggggauucaccaaaucuucggcgccgcguuuaaauccuuguucggaggcaugucuugguuuucgcagauccugauugggacucuccugauguggcuuggacugaacaccaagaauggcagcaucuccuugaugugucucgcccugggugggguuuuaauuuuccugucaacggcugucagugca

SEQ ID NO: 1844 - RNA, 2061 nt, Artificial Sequence
  KY014320.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaagcucggucgcagacguggcuggagucacgcgaguacacuaagcaccuuauuagaguugaaaauuggaucuuuaggaaccccggguucgcacuggccgcugccgcgauugcaugguugcucggaagcaguaccucccagaaagugaucuaucuggucaugauacugcucaucgccccugcuuacucuauucggugcaucggcgugagcaaucgcgacuuuguagagggcauguccgggggaacauggguugauguggucuuagaacaugguggcugugugacugugauggcccaggacaagccaaccgucgauauugagcugguuacaaccacggugucaaacauggcagagguacgaaguuacugcuaugaagcuagcaucucugacauggccuccgauucaagaugucccacucaaggggaggcguaccuugacaagcagagcgacacacaguaugugugcaaaaggaccuuggucgaucggggauggggcaaugguugugggcuguucggaaagggcagucuagugacuugcgccaaauuugcaugcucuaagaaaaugacaggcaaguccauacagccugaaaaccucgaguaccguauuaugcugagcguucacgggucgcaacacucuggaaugaucgugaaugacaccggucaugaaacggaugagaaccgcgcuaaggucgagauuaccccaaauucccccagagccgaagcuacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugcc

SEQ ID NO: 1845 - RNA, 2061 nt, Artificial Sequence
  KY328290.1 prME-short CDS opt
accagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaaaggggucucauauaguuuguguacugccgcuuucacguuuuccaagaucccugccgagacacuccauggaaccgugacugaagagguucaguacgcaggcaccgacgguccaugcaaagugcccgcgcaaauggcuguagacaugcagacacugaccccugucgggagguuaauuacugccaauccagugauaacagaaagcacggagaacucuaagaugaugcuggagcuagaucccccguucggcgacucauacaucguuauuggagugggcgaaaagaagaucacccaccacuggcaucggagugggagcacuauaggaaaggcauuugaggccacaguccgcggugcuaaaagaauggccgugcucggcgauaccgcaugggacuucggguccguaggaggcgcucugaacucucuugguaaggggauucaccagaucuucggcgccgcguuuaaaucguuguucggaggcaugagcugguuuucccaaauccugauugggacacuccugauguggcuuggacugaauacuaagaacggcucaaucaguuugaugugucucgcccugggugggguguuaauuuuccugucuaccgcuguuagcgca

SEQ ID NO: 1846 - RNA, 2061 nt, Artificial Sequence
  KU681081.3 prME-short CDS opt
accagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgccccugcauacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacacuggggcugacaccggcacaccccauuggaauaacaaagaggcccuuguagaauuuaaggaugcacacgccaaacggcagaccguugugguccugggaucccaggagggcgcugugcauacugcguuggcaggggcccuagaggcugaaauggacggagccaagggucgacugucuagcggccaccucaaaugccgccugaagauggauaagcugagacugaaaggggucucauauaguuuguguacggcagccuucacauuuaccaagaucccugcugagacucuccauggaaccgugacaguugaagugcaguacgccggcaccgacgguccaugcaaaguacccgcacaaauggcggucgacaugcagacucugacaccuguggggagguuaauuacggcuaauccaguuauaaccgagggcacugaaaacuccaagaugaugcuggagcuagaucccccguucggagacagcuacaucgugauuggcgucggggagaaaaagaucacacaccacuggcaucggucuggaucaaccauagguaaggccuuugaagcaacagugcgcggcgccaaaagaauggcuguacucggggauacugccugggacuucggaagugugggcgguguucugaacagccuugggaagggcauucaccagaucuucggagcagcuuuuaaauccuuguucggcgggaugucuugguuuucgcaaauccugauuggaacccuccugauguggcuuggccugaauacgaagaacgguagcaucuccuugaugugucucgcccuugggggagucuuaauuuuccugucaaccgcggugagugcc

SEQ ID NO: 1847 - RNA, 2061 nt, Artificial Sequence
  KX827309.1 prME-short CDS opt
accagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugaugugucucgcccugggugggguuuuaauuuuccugaguacggcugucucugca

SEQ ID NO: 1848 - RNA, 2061 nt, Artificial Sequence
  KU955593.1 prME-short CDS opt
accagcgugggcaucgucgggcugcuccuuacaacugccauggcuguugaggugacgagaaggggaaacgcauacuauauguaccuggaccgguccgaugccggugaagcgauuucuuuccccaccacaaugggcaugaauaagugcuauauacagaucauggacuuggggcacaugugugaugcuacuaugucauacgagugcccuauguuagacgaaggaguagagccagaugacguggauuguuggugcaacaccacaaguaccugggucguguauggcacuugucaucacaaaaagggugaagcccgccgaagccguagagcaguuacacugccgucccauucuaccaggaaacuacaaacgcggucgcagacuuggcucgagucacgcgaguacaccaagcaccugauuagaguggaaaauuggaucuuuaggaaccccggguucgcccuugcugcagccgcuauugccuggcuguugggaagcaguacaucccagaaagucaucuaucucgugaugauacugcugaucgcgccugcauacucuauucggugcaucggcguaagcaaucgcgacuuuguugagggcauguccgggggaacuuggguggaugucgugcucgaacaugguggcugugugaccgucauggcccaggacaagccaacaguugauauugaguuagugaccacgacuguaucaaacauggcugaggugcgaaguuacugcuaugaagccagcaucucugacauggcauccgauucaagaugucccacacaaggggaggcuuaccuggacaagcagagcgacacccaguaugucugcaaaaggacucuuguggaucggggauggggcaaugguuguggguuguucggaaagggcagucugguuacaugcgccaaauuugcgugcucuaagaaaaugaccggcaaguccauacagccugaaaaccuagaguaccguauuaugcucagcgugcacgggucgcaacacucuggaaugaucgucaaugacacgggucaugaaaccgaugagaaccgcgccaagguggagauuacaccaaauucccccagagcagaagcuacucugggcggguucggaucacuuggccuggacugugagccuaggaccgguuuggauuuuagugaccucuauuaccugacaaugaacaauaaacacugguuaguacauaaggaaugguuccacgauaucccacugccguggcacgccggggcugacacuggcacaccccauuggaacaauaaagaggcccucguugaauuuaaggaugcacacgccaaacggcagaccguggucgugcuuggaagccaggagggcgcuguccauaccgcgcuggcaggggccuuggaggcugaaauggacggagccaagggucgacuauccucuggccaccugaaaugccgccucaagauggauaagcugagacuuaaaggggugagcuauucacuguguacugcagccuucacguuuacaaagaucccugcugagaccuugcauggaacuguuaccguggaaguacaguacgccggcacagacgguccaugcaaaguccccgcacaaauggcgguggacaugcagacccucacuccuguugggaggcugauuacagcuaacccagugauaacggagaguaccgaaaacuccaagaugauguuagagcuggaucccccguucggcgacagcuacaucgucauuggagugggcgagaaaaagaucacucaccacuggcaucggucugggucaacaauaggaaaggccuuugaagcaaccguacgcggugccaaaagaauggcugugcuaggcgauacagccugggacuucgggaguguuggaggcgcacucaauagccuggguaaggggauucaccagaucuucggcgcugccuuuaaaucccuuuucggaggcaugucuugguuuucgcaaaucuugauugggacucugcucgucuggcugggacuuaacaccaagaauggcagcaucucccugauguguuuggcgcucgguggggugcugauuuucuuaucaacggccgugagugcu

SEQ ID NO: 1849 - RNA, 2061 nt, Artificial Sequence
  KY272987.1 prME-short CDS opt
accagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugguuugucucgcccuggguggggucuuaauuuuccugaguacggcugugucugca

SEQ ID NO: 1850 - RNA, 2061 nt, Artificial Sequence
  KY007221.1 prME-short CDS opt
accagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcgugaacaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugguuugucucgcccuggguggggucuuaauuuuccugucaacggcugugagugca

SEQ ID NO: 1851 - RNA, 2061 nt, Artificial Sequence
  EU545988.1 prME-short CDS opt
accagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgcuauugccugguugcucggaaguuccacaucucagaaagucaucuaucuggugaugauacugcucaucgcgccugcauacagcauucggugcaucggcguauccaaccgcgacuuuguugagggcaugucagggggaacuuggguggaugucguguuagaacaugguggcugugugaccgucauggcccaggacaagccagcuguugauauugagcuggugacaaccacgguaaguaauauggccgaggugcgaagcuacugcuaugaagcaucuaucuccgacauggcuucagauagcagaugucccacucaaggggaggccuaccuugacaagcagagugacacacaguaugucugcaaaaggaccuugguggaucggggauggggcaacgguugugggcuguucggaaagggcucucuaguuacuugcgcgaaauuugccugcuccaagaaaaugacaggcaagagcauacagccugaaaaucucgaguaccguauuaugcugucggugcacgggucucaacacuccggaaugaucgucaacgacaccggucaugaaacggaugagaaucgcgcaaagguggagauuaccccaaacucacccagagcugaagccacacuuggcggguucggaagucugggcuuggacugugagccuaggacuggucucgauuuuagcgaccuguauuacuuaaccaugaauaacaaacacuggcugguacauaaggaaugguuccacgauaucccacucccguggcacgcuggggccgacacaggcacuccccauuggaauaacaaagaggcacuuguugaauuuaaggaugcccacgcuaaacggcagaccguggucgugcugggaucccaggagggcgcgguccauacagcauuggccggggcucuagaggccgaaauggacggagcaaagggucgacugucuagcggccaccucaaaugccgccugaagauggauaaacuuagacugaagggggugucauauaguuuguguaccgccgcuuucacuuuuacgaagaucccugccgagacacuccauggaaccguuacuguggaaguacaguacgcaggcaccgacgguccaugcaaaguccccgcgcaaauggcuguggacaugcagacacugaccccuguugggagguuaauuacugccaauccagugauaacagaguccacggaaaacagcaagaugaugcuggagcuagaucccccguucggcgacucuuacaucgucauuggagugggcgagaaaaagaucacccaccacuggcaucggucagggaguacuauaggaaaggcauuugaagccacaguacgcggugcuaaaagaauggccgugcucggcgauaccgcaugggacuucgggagcguuggaggcgcucugaacucccuugguaaggggauucaccagaucuucggcgccgcguuuaaaucuuuguucggaggcaugucgugguuuagccaaauccugauugggacacuccuggucuggcuuggacugaauacuaagaacggcuccaucucauugaccugucucgcccugggugggguguuaauuuuccugaguacggcugugucugca

SEQ ID NO: 1852 - RNA, 2061 nt, Artificial Sequence
  KU681082.3 prME-short CDS opt
accagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgucauugcuugguugcucggaaguuccacaucucagaaagugaucuaucugguaaugauacugcucaucgccccugcguacagcauucggugcaucggcguuuccaaccgcgacuuuguggagggcaugucagggggaacuugggucgaugugguguuagaacaugguggcugugucaccguuauggcacaggacaagccaacaguggauauugagcugguaaccacgacugugaguaauauggccgagguccgaagcuacugcuaugaggcuucuaucuccgacauggccucagauagcagaugucccacacaaggggaagcauaccuugacaagcagagugacacccaguaugugugcaaaaggacuuugguugaucggggauggggcaacgguugugggcuguucggaaagggcucucuagugacaugcgcuaaauuugccugcuccaagaaaaugaccggcaagagcauacagccugaaaaucucgaguaccguauuaugcugucgguccacgggucucaacacuccggaaugaucgugaacgacacgggucaugaaaccgaugagaaucgcgcgaagguagagauuacaccaaacucacccagagccgaagcaacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgcuggggccgacacuggcacaccccauuggaauaacaaagaggcucuuguggaauuuaaggaugcccacgcaaaacggcagaccgucgugguccugggaucccaggagggcgccgugcauaccgcuuuggcgggggcacuagaggccgaaauggacggagcuaagggucgacugucuagcggccaccucaaaugccgccugaagauggauaaacuuagacugaaggggguuucauauaguuuguguacugccgcauucacguuuacaaagaucccugccgagacccuccauggaacugugaccguagaaguccaguacgcuggcacagacgguccaugcaaagugcccgcccaaauggcaguugacaugcagacccugacuccuguggggagguuaauuacagcgaauccagucauaacggaguccaccgaaaacagcaagaugaugcuggagcuagaucccccguucggcgacucuuacaucgugauuggaguaggcgagaaaaagaucacucaccacuggcaucggucagggaguacaauaggaaaggcuuuugaagccaccgugcgcggugcaaaaagaauggccguucucggcgauacagcuugggacuucgggagcgucggaggcgcccugaacucccuugguaaggggauucaccagaucuucggcgcagcuuuuaaaucuuuguucggaggcaugucgugguuuagccaaauccugauugggacucuccugguguggcuuggacugaauaccaagaacggcuccaucucauugacgugucucgcccugggugggguguuaauuuuccugaguaccgcggucucugcc

SEQ ID NO: 1853 - RNA, 2061 nt, Artificial Sequence
  KX601167.1 prME-short CDS opt
accagcgugggcaucgucgggcugcuccuuacaacugccauggcuguugaggugacgagaaggggauccgcauacuauauguaccuggaccggucugaugccggugaagcgauuucauuccccaccacauugggcguaaacaagugcuauauacagaucauggacuuagggcacaugugugaugcuacuaugaguuacgagugcccuaugcuggacgaaggaguggagccagaugacgucgauuguuggugcaauaccacaagcaccugggugguuuauggcacuugucaucacaaaaagggugaagcccgccgaucccguagagcagugacacuaccgucucauucgaccaggaaacuccaaacgcggucacagacuuggcuggagagccgcgaguacaccaagcaccuuauuagagucgaaaacuggaucuuuaggaaucccggguucgcccuggcugcagccgcuauugccugguugcucggaaguuccacaucucagaaagugaucuaucugguaaugauacugcucaucgcgccugcauacagcauucggugcaucggcguuuccaaccgcgacuuuguggagggcaugucagggggaacuugggucgaugugguguuagaacaugguggcugugucaccguuauggcccaggacaagccaacaguggauauugagcugguaaccacgacugugaguaauauggcugagguccgaagcuacugcuaugaagccucuaucuccgacauggcaucagauagcagaugucccacacaaggggaggcuuaccuugacaagcagagugacacccaguaugugugcaaaaggacuuugguugaucggggauggggcaacgguugugggcuguucggaaagggcucucuagugacaugcgccaaauuugcgugcuccaagaaaaugaccggcaagagcauacagccugaaaaucucgaguaccguauuaugcugucgguccacgggucucaacacuccggaaugaucgugaacgacacgggucaugaaaccgaugagaaucgcgccaagguagagauuacaccaaacucacccagagcagaagcuacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgccggggcugacacuggcacaccccauuggaauaacaaagaggcccuuguggaauuuaaggaugcacacgccaaacggcagaccgucgugguccugggaucccaggagggcgcugugcauaccgcguuggcaggggcccuagaggcugaaauggacggagccaagggucgacugucuagcggccaccucaaaugccgccugaagauggauaaacuuagacugaaggggguuucauauaguuuguguacugcagccuucacguuuacaaagaucccugcugagacccuccauggaacugugaccguagaaguccaguacgccggcacagacgguccaugcaaagugcccgcacaaauggcgguugacaugcagacccugacuccuguggggagguuaauuacagcuaauccagucauaacggaguccaccgaaaacagcaagaugaugcuggagcuagaucccccguucggcgacucuuacaucgugauuggaguaggcgauaaaaagaucacucaccacugguaucggucagggaguacaauaggaaaggccuuugaggcaaccgugcgcggugccaaaagaauggcuguucucggcgacacagccugggauuucgggagcgucggaggcgcacugaacucccuugguaaggggauucaucagaucuucggcgcugccuuuaaaucuuuguucggaggcaugucgugguuuagccaaauccugauugggacucuccugguguggcuuggacugaauaccaagaacggcuccaucucauugacgugucucgcgcugggugggguguuaauuuuccugaguaccgccgucucugcu

SEQ ID NO: 1854 - RNA, 2061 nt, Artificial Sequence
  KX694533.2 prME-short CDS opt
accagcgugggcaucgucgggcugcuccuuacaacugccauggcuguugaggugacgagaaggggauccgcauacuauauguaccuggaccggucugaugccgguaaggcgauuucauuccccaccacauugggcguaaacaaaugcuauauacagaucauggacuuagggcacaugugugaugcuacuaugaguuacgaaugcccuaugcuggacgagggaguggaaccagaugacgucgauuguuggugcaauaccacaagcaccugggugguuuauggcacuugucaucacaagaaaggugaggcccgccgaucccguagagcagugacacuaccgucucauucgaccaggaagcuccaaacgcggucacagacuuggcuggaaagccgcgaguacaccaaacaccuuauuagagucgagaacuggaucuuuaggaaucccggguucgcccuggcugcagccgcuauugccugguugcucggaaguuccacaucucagaaggugaucuaucugguaaugauacugcucaucgcgccugcauacagcauucggugcaucggcguuuccaaccgcgacuuuguggaaggcaugucagggggaacuugggucgaugugguguuagagcaugguggcugugucaccguuauggcccaggacaagccaacaguggauauugaacugguaaccacgacugugaguaauauggcugagguccgaagcuacugcuaugaggccucuaucuccgacauggcaucagauagcagaugucccacacaaggggaggcuuaccuugacaaacagagugacacccaguaugugugcaagaggacuuugguugaucggggauggggcaacgguugugggcuguucggaaaaggcucucuagugacaugcgccaaguuugcgugcuccaaaaagaugaccggcaagagcauacagccugaaaaucucgaauaccguauuaugcugucgguccacgggucucaacacuccggaaugaucgugaacgacauuggucaugagacggaugaaaaucgcgccaaaguagagaucaccccaaacucacccagagcagaggcuacacuuggcggguucggaagucugggcuuggacugugaaccuaggacuggucucgauuuuagcgaccuguauuacuuaaccaugaauaacaagcacuggcugguucauaaagagugguuccacgauaucccacucccguggcacgccggggcugacacaggcacuccccauuggaauaacaaggaagcccuuguggaguuuaaagaugcacacgccaagcggcagaccgucgugguccugggaucccaggaaggcgcugugcauacagcguuggcaggggcccuagaggcugagauggacggagccaaaggucgacugucuagcggccaccucaagugccgccugaagauggauaaacuuagacugaaggggguuucauauaguuuguguaccgcagccuucacuuuuacgaaaauuccugcugaaacacuccauggaaccgugacuguagagguccaguacgccggcaccgacgguccaugcaaggugcccgcacaaauggcgguugacaugcagacacugaccccuguggggagguuaauaacugcuaauccagucaucacagaauccacggagaacagcaaaaugaugcuggaacuagaucccccguucggcgacucuuacauugugaucggaguaggcgauaagaagauaacccaccacuggcaucggucagggaguacuauuggaaaagccuuugaggcaacagugcgcggugccaagagaauggcuguucucggcgacaccgccugggauuucgggagcgucggaggcgcacugaacucccuugguaaagggauccaccagaucuucggcgcugccuuuaagucuuuguucggaggcaugucgugguuuagccaaauucugaucgggacacuccugguguggcuuggacugaauacuaaaaacggcuccauuucauugaccugucucgcgcugggugggguguuaauauuccugaguacggccgucucugcu

SEQ ID NO: 1855 - RNA, 2061 nt, Artificial Sequence
  KY288905.1 prME-short CDS opt
accagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacacaggucacgagacugaugaaaaucgugccaagguagagguuaccccuaacucaccacgcgcggaggccacacuuggcggguucggaagucugggcuuggacugugaacccagaacuggucucgauuuuagcgaccuguacuauuuaaccaugaauaacaaacauuggcuggugcacaaggagugguuccacgauaucccucucccauggcaugcaggggcugacacaggcaccccgcacuggaauaacaaagaagcccuugucgaguuuaaggaugcucaugccaaaaggcagacuguggucgugcugggaucccaggaaggcgcaguucacacggccuuggcuggggcgcuagaggcagagauggacggagccaagggucggcuguucucuggccaucucaagugccgacugaaaauggauaaacuucgccugaagggggugagcuacucauuguguacagcugccuuuaccuucacuaagguacccgcagaaacccuccacggaacagucaccguggagguucaguaugccggcacugacgguccuugcaaagugccagcucaaauggccgucgacaugcagacacugacgcccguggggagauuaaucaccgcaaauccuguaauuacugaaaguacagagaacuccaagaugaugcuggaacuagauccacccuuuggcgacagcuacauagugaucggaguuggcgauaagaaaauuacccaccauuggcacaggucugggucaacaaucggaaaggcguucgaggcuacuguccggggugccaaacgcauggcagugcucggcgacaccgccugggauuucgggagugugggaggcgucuuuaacagccuggguaaggggauacaucagauuuucggcgcugccuuuaaaucccuuuucggaggcaugucuugguuuucgcaaaucuugaucgggacgcugcucguuuggcugggacuuaauaccaagaacggcagcauuucccugacauguuuggcacucgguggggugaugaucuuccugucaacugcugugagugcc

SEQ ID NO: 1856 - RNA, 2061 nt, Artificial Sequence
  KF268950.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacaucggucacgagacggaugaaaaccgugccaaggucgaggugaccccuaauucaccacgcgcagaggcuacacuuggcggguucggaagucugggcuuggacugugaacccagaacuggucucgauuuuagcgaccuguacuauuuaaccaugaacaauaaacauuggcugguacacaaggagugguuccacgauauuccucucccauggcaugccggggcugacacaggcacuccgcacuggaacaauaaagaagcccuuguugaguuuaaggaugcacaugccaaaaggcagaccguggucgugcugggaucccaggaaggcgcuguccacacagcguuggcaggggcccuagaggcugagauggacggagccaagggucggcuguucucuggccaucucaagugccgacugaaaauggauaaacuucgccugaagggggugagcuacucauuguguaccgcagccuuuacuuucacgaagguucccgcugaaacacuccacggaaccgugacuguagagguccaguaugccggcaccgacgguccuugcaaagugccagcacaaauggcgguugacaugcagacacugacccccguggggagauuaauaacugcuaacccugucaucacagaaaguacggagaacuccaagaugaugcuggaacuagauccacccuuuggcgacagcuacauugugaucggaguaggcgauaagaaaauaacccaccauuggcacaggucugggucaacuauuggaaaggccuucgaggcaacagugcggggugccaaacgcauggcuguucucggcgacaccgccugggauuucgggagugucggaggcguguuuaauagccuggguaagggggugcaucagaucuucggcgcagcuuuuaaaucccuuuucggaggcaugucuugguuuucgcaaaucuugauugggacacugcucgucuggcugggacuuaacacuaagaauggcagcaucucccugaccuguuuggcccucggugggguuaugauuuuccugucaacggcggugagugcc

SEQ ID NO: 1857 - RNA, 2061 nt, Artificial Sequence
  KF383121.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaucggucacgagaccgaugaaaaucgugcgaagguggagguaacaccuaacucaccacgcgccgaggcaacucuuggcggguucggaagucugggcuuggacugugaacccagaaccggucucgauuuuagcgaccuguacuauuuaacaaugaauaacaaacauuggcugguucacaaggagugguuccacgauauuccucucccauggcaugcuggggccgacacuggcaccccgcacuggaauaacaaagaagcucuuguggaguuuaaggaugcccaugcaaaaaggcagacagucgugguccugggaucccaggaaggcgccgugcacaccgcuuuggcgggggcacuagaggccgagauggacggagcuaagggucggcuguucucuggccaucucaagugccgacugaaaauggauaaacuucgccugaaggggguuagcuacucauuguguacugccgcauuuacguucacaaaggugcccgccgaaacccuccacggaacuguaaccgucgaggugcaguaugcuggcacagacgguccuugcaaaguuccagcccaaauggcaguggacaugcagacccugacucccgucgggagauuaauaacagcgaauccugugaucacggaaaguaccgagaacuccaagaugaugcuggaacuagauccacccuuuggcgacagcuacauuguaaucggagugggcgauaagaaaauaacucaccauuggcacaggucugggucaacaauuggaaaggcuuucgaggccaccguucggggugcaaaacgcauggccguccucggcgacacagcuugggauuucgggagugugggaggcguguuuaacagccuggguaaggggauccaucagaucuucggcgccgcauuuaaaucccuuuucggaggcaugucuugguuuucgcaaauuuugaucgggacucugcucgucuggcugggacuuaauaccaagaacggcagcauuucccugacguguuuggcucucggugggguuaugauauuccugucaaccgccgugagugcg

SEQ ID NO: 1858 - RNA, 2043 nt, Artificial Sequence
  KF268949.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacgagaaccgugccaaggucgaagugacgccuaauucaccacgcgcagaggcuacccuugguggcuucgggagucugggauuggauugugagcccagaacaggccucgacuuuagcgaucuguacuauuuaacuaugaacaauaaacacuggcugguacauaaggaaugguuccacgacaucccucucccauggcacgccggugcugauaccgggacaccgcauuggaacaauaaagaggcccuuguugaauuuaaggacgcacacgccaaaaggcagacuguggucgugcugggcucccaggagggagcuguccauaccgcguuggcaggcgcccuagaagcugagauggauggggccaagggacggcuguucucuggucaccucaagugccgacugaaaauggacaaacuucgccugaagggcgugagcuacucauuguguacagcagccuuuaccuucacuaagguucccgcugagacgcuccaugggacagugaccguagaaguccaguaugccggaacugauggcccuugcaaagugccagcacaaauggcgguugacaugcagacccugacacccguggguagauuaauuaccgcuaacccugucauaacugagaguacagaaaacuccaagaugaugcuggagcuagacccacccuuuggggauagcuacaucgugauuggcguaggagacaagaaaaucacgcaccacuggcauaggucuggcucaaccauagggaaggccuucgaagcaacugugcggggagccaaacgcauggcuguucucggugauacagccugggacuucggcagugucgggggaguguuuaauagccugggcaaggguauucaccagaucuucggggcagcuuuuaaaucccuuuucggcggaaugucuugguuuucgcaaaucuugauuggcacccugcucguguggcuggggcuuaacacaaagaauggaagcaucucccugacuuguuuggcccucggcggugucaugauuuuccugucaaccgcgguuagugcc

SEQ ID NO: 1859 - RNA, 2061 nt, Artificial Sequence
  KU955595.1 prME-short CDS opt
accagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacaccggucacgagacagaugaaaaucgugcgaagguagagguuacuccuaacucaccacgcgccgaggcaacccuuggcggguucggaagucugggcuuggacugugaacccagaacaggucucgauuuuagcgaccuguacuauuuaacuaugaauaacaaacauuggcuggugcacaaggagugguuccacgauaucccucucccauggcaugcuggggccgacaccggcacaccgcacuggaauaacaaagaagcucuugucgaguuuaaggaugcccaugcaaaaaggcagaccguggucgugcugggaucccaggaaggcgccguucacacugcuuuggcgggggcacuagaggccgagauggacggagcuaagggucggcuguucucuggccaucucaagugccgacugaaaauggauaaacuucgccugaagggggugagcuacucauuguguacggccgcauuuacauucaccaagguacccgccgaaacucuccacggaaccgucacaguggagguucaguaugcuggcaccgacgguccuugcaaagugccagcccaaauggcagucgacaugcagacucugacacccguggggagauuaaucacggcgaauccuguaauuaccgaaaguacugagaacuccaagaugaugcuggaacuagauccacccuuuggcgacagcuacauagugaucggaguuggcgauaagaaaauuacacaccauuggcacaggucugggucaaccaucggaaaggcuuucgaggccacaguccggggugcaaaacgcauggccgugcucggcgacacugcuugggauuucgggagugugggaggcgucuuuaacagccuggguaaggggauacaucagauuuucggcgccgcauuuaaaucccuuuucggaggcaugucuugguuuucgcaaaucuugaucgggacccugcucguuuggcugggacuuaauacgaagaacggcagcauuucccugaccuguuuggcucucgguggggugaugaucuuccugucaacagccgugagugcg

SEQ ID NO: 1860 - RNA, 2061 nt, Artificial Sequence
  KF383116.1 prME-short CDS opt
accagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaacacaagaaaggugaggcccgccgaucccguagagcugugacacuaccaucucauucgaccaggaagcuccagacgcggucacagacuuggcuggaaagccgcgaguauaccaaacaccuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcaugguggcugugucaccguuauggcccaagacaaaccuacaguggauaucgaacugguaaccacgacugugaguaauauggcugagguccgcagcuacugcuacgaggccucuauauccgacauggcaucagauagccgauguccaacacagggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucaacccgaaaaucucgaauaucggaucaugcugucgguccacgggucucagcacuccggaaugauugugaacgacaucggucaugagaccgaugaaaaucgugcgaagguagagguuacaccuaacucaccacgcgccgaggcaacucuuggcggguucggaagucugggcuuggacugugaacccagaaccggucucgauuuuagcgaccuguacuauuuaacaaugaauaacaaacacuggcuggugcauaaggagugguuccacgauaucccucucccauggcacgcuggggccgacacuggcaccccgcauuggaauaacaaagaagcucuugucgaguuuaaggaugcccacgcaaaaaggcagacaguggucgugcugggaucccaggaaggcgccguucauaccgcuuuggcgggggcacuagaggccgagauggacggagcuaagggucggcuguucucuggccaccucaagugccgacugaaaauggauaaacuucgccugaagggggugagcuacucauuguguacugccguaugcacggcagccaagguccccgcugaaacacuccauggaaccgugacuguugaggugcaauaugccggcaccgacgguccuuguaaagucccagcacagauggcgguggacaugcagacacugacccccguagggagauuaauuacugcuaauccugugauaacagaaaguacggagaacuccaagaugaugcuggaacuagauccacccuuuggcgacagcuacaucguuauuggagucggcgauaagaaaaucacccaccacuggcauaggucugggucaacuauaggaaaggccuucgaggcaacagugcggggugccaaacgcauggcugugcucggcgacaccgccugggauuuugggagugucggaggcguuuucaacagccuggguaaggggauucaccaaaucuucggcgcagcuuuuaaaucccuuuucggaggcaugucuugguuuucgcagaucuugauugggacacugcucguguggcugggacuuaauacuaagaacggcagcaucucccugaccugcuuggcccucgguggggugaugauuuuccugucaacggcgguaagugcc

SEQ ID NO: 1861 - RNA, 2043 nt, Artificial Sequence
  KX601166.1 prME-short CDS opt
accagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacgagaaucgugcgaagguagaaguuaccccuaacucaccacgcgccgaggcaacacuugguggcuucgggagucugggauuggauugugagcccagaacuggccucgacuuuagcgaucuguacuauuuaaccaugaauaacaaacacuggcuggugcauaaggaaugguuccacgacaucccucucccauggcacgcuggugccgauacagggacuccgcauuggaauaacaaagaggcucuugucgaauuuaaggacgcccacgcaaaaaggcagaccguggucgugcugggcucccaggagggagccguucauacagcuuuggcgggcgcacuagaagccgagauggauggggcuaagggacggcuguucucuggucaccucaagugccgacugaaaauggacaaacuucgccugaagggcgugagcuacucauuguguaccgccgcauuuacuuucacgaagguacccgccgagacacuccaugggaccgucacuguggaaguucaguaugcuggaaccgauggcccuugcaaagugccagcccaaauggcagucgacaugcagacacugacccccguggguagauuaaucacugcgaauccuguaauuacagagaguacggaaaacuccaagaugaugcuggagcuagacccacccuuuggggauagcuacauagugaucggcguuggagacaagaaaauuacccaccacuggcauaggucuggcucaacuaucgggaaggcuuucgaagccacaguccggggagcaaaacgcauggccgugcucggugauaccgcuugggacuucggcagugucgggggaguguuuaacagccugggcaaggguauacaccagauuuucggggccgcauuuaaaucccuuuucggcggaaugucuugguuuucgcaaaucuugaucggcacacugcucguuuggcuggggcuuaauacuaagaacggaagcauuucccugaccuguuuggcucucggcggugugaugaucuuccugucaacggccgugagugcg

SEQ ID NO: 1862 - RNA, 2061 nt, Artificial Sequence
  KF383118.1 prME-short CDS opt
accagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugagacacgccgaucccguagaucugucucgcuaagguaucacuacacccggaagcuccaaacgcgcucacagacuuggcuggaaagcagagaguauaaaaagcaucuuauuaugguggagaacuggaucuuuaggaauccaggguucgccauaguuaguguggcuaucaccuggcugaugggauccuugacaucucagaaggucauuuaccucgugaugaucguacugauuguuccggcauacagcaucuccugcauaggcgugucaaaccgggaccuggucgaaggcaugagugggggaacuuggguggaugugguccucgagcacgguggcuguguuaccgaaauggcccaggacaaacccacaguggauauugaguuaguaaccaugacggugagcaauauggcugagguccgcucuuauugcuacgaagccucccugucagacauggcgagcgcaagucgauguccuacucaaggggagccaucucuugauaagcaguccgacacacagagcgugugcaaaagaaccuugggagacaggggcugggguaacggguguggaaucuuuggcaagggcucgcugguuacuugcucuaaauucacaugcuguaagaagaugcccgggaaauccauucagccugaaaaucuagaguaucggaucaugcucccagugcacggaucacaacauagugguaugaucgucaacgauauuggccacgaaaccgacgagaaucgugccaagguggagguaacgcccaacagcccucgcgcugaagccacccugggaggguuuggcucccuuggucuggauugcgagccaagaacaggguuggacuucucugaucucuacuaucugacuaugaauaacaaacauugguuaguucacaaggaaugguuucacgacauaccgcugcccuggcaugcaggcgcugauaccggaacaccucacuggaauaacaaagaggcccucguggaguucaaggacgcgcaugccaaaaggcagacugucgugguccuuggcagccaggaaggggcagugcacaccgcucuggccggagcuuuggaggccgaaauggauggugcaaagggccggcuauuuucagggcaucugaagugucgacucaaaauggacaagcugcgccuuaaaggaguuaguuacucccugugcacagccgcuuucaccuuuacuaaggugccagcggagacguugcacggcacaguaaccgucgaagugcagagcgcagguacugaugggcccuguaaaguuccugcccaaauggcuguggacaugcagacccucacaccagucggcagacugaucaccgccaaucccgugauuacugagucuacagaaaacucaaagaugauguuagagcuggacccgccuuucggagauaguuauaucguaauaggcgugggggacaagaaaauuacgcaccauuggcacaggagcggauccaccaucgguaaggcauuugaggccacuguucggggcgcuaaacgcauggccguccuaggggauacagcaugggacuucggaucugugggcgguguguucaacucgcucgggaagggcauccaucagauuuuuggagcggcuuucaaaagccuguuuggcgggauguccugguucucacaaauccuuauuggaaccuugcuggucuggcucggccugaauacaaagaacgguaguauaucucuuacuugccuggcccucgggggaguuaugaucuuuuugagcaccgcaguguccgcc

SEQ ID NO: 1863 - RNA, 2058 nt, Artificial Sequence
  KX447520.1 prME-short CDS opt
agcgugggcaucgucgggcugcuccuuaccacagccauggcugcagagguuacuagaaggggauccgccuacuauauguaccuggaccggaacgaugcgggugaagcuauuucuuuccccacgaccuugggcaugaauaagugcuauauacagaucauggacuuagggcacaugugugaugccacaaugucauacgagugcccuaugcuggacgaaggaguggagccagaugacguagauuguuggugcaacacuaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugca

SEQ ID NO: 1864 - RNA, 2061 nt, Artificial Sequence
  KU761561.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuagaaggauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugca

SEQ ID NO: 1865 - RNA, 2061 nt, Artificial Sequence
  KX806557.2 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauguuuaggaaccccggguucgcucuggcagccgcugccaucgcgugguugcucggaagcaguacaucccagaaagugauuuaucuggucaugauccugcucauagcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauuucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauccagccugaaaaccucgaguaccguauaaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauauuccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaaucacagccaacccaguuauuacggagaguaccgaaaacuccaagaugaugcuggagcuagaucccccguucggcgacagcuacauagugaucggagucggcgagaaaaagauuacucaccacuggcaucggucugggucaacaaucggaaaggcauuugaagccaccgugcgcggugcuaaaagaauggccguacucggcgauacagcaugggacuucgggagugugggaggcgcucugaauagccuugguaaggggauacaccagauuuucggcgccgcguuuaaauccuuguucggaggcaugucuugguuuucgcaaauccugaucgggacucuccugauguggcuuggacugaacaccaagaauggcagcauuuccuugaugugucucgcccugggugggguuuuaaucuuccugucaacggcugucagugca

SEQ ID NO: 1866 - RNA, 2061 nt, Artificial Sequence
  LC191864.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaugaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugca

SEQ ID NO: 1867 - RNA, 2061 nt, Artificial Sequence
  KU744693.1 prME-short CDS opt
accagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgcuauggcccaggacaagccaacaguggauauugagcuggucaccacgacuguuucaaacauggcagaggugcgaaguuacugcuaugaagcuagcaucucugacauggccuccgauucaagaugucccacacaaggggaggcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauacagccugaaaaccucgaguaccguauuaugcugagcgugcacgggucgcaacacucuggaaugcuuguuaaugacacgggucaugaaaccgaugagaaccgcgcuaagguggagaucacaccaaauucccccagagccgaagcuacucugggcggguucggaucauugggccucgacugugagccuaggaccggucuggauuuuagugacuuauauuaccugacaaugaacaauaaacacuggcucgcccauaaggaaugguuccacgauauuccacuuccguggcacgcaggggccgcuacuggcaccccucauuggaacaauaaagaggcgcuggucgaauuuaaggacgcacacgccaaacggcagacagugguaguuuugggaagccaggagggcgcugugcauaccgcccuagcaggggcccuggaggcugaaauggauggagccaagggucgacucuccucuggccaccugaaaugccgccuuaagauggacaagcugagauugaaaggggucagcuauucacucuguacugcagcguucacguuuacaaagaucccugcugagaccguggauggaacugucaccguggaaggccaguacggugggacagacggcccaugcaaaguucccgcccaaauggcaguggacaugcagacccugacuccuguaggaagguuaaucacagccaacccagucauuacggagaguaccgaaaacuccaagaugaugcuggagcuagaucccccguucggcgacagcuacauagugaucgggguuggagagaaaaagauuacucaucacuggcaccggucugguucaacaaucggcaaggcuuuugaagccaccgugcgcggggcaaaaagaauggcuguccucggagauacagccugggacuucggcaguguggguggggcgcugaauagccuuggcaagggaauacaucagauuaucggcgccgcuuucaaauccuuguuugggggaaugucuugguucucgcaaauccugauuggcacucuccugauguggcuuggucugaacaccaagaaugggagcaucuccuugaugugucucgcacugggaggcguauuaauuuuucugucaacggccgugaguggu

SEQ ID NO: 1868 - RNA, 2052 nt, Artificial Sequence
  KU963574.2 prME-short CDS opt
ggcgccgacgcuagcaucgggauugugucccugcuccuuaccacagucauggcagccgagauaacuagaaggggaucugcguacuauauguaccuggaucggucagacgcugguaaggccaucaguuucguuacgaccuugggcgugaacaaaugccacguacagauuauggauuuagggcauaugugugacgcaacaaugagcuaugaaugccccaugcuggaugagggaguggaaccugacgaugucgacuguuggugcaauacuaccuccacaugggugguuuacggcaccugucaccauaagaaaggugaggcccgccgaucucguagagcugugacucuaccaucgcacucaacaaggaagcuccaaacccggagccagacguggcuggaaagucgcgaguauacuaaacaucuuaucaaggucgagaacuggauuuuuagaaauccgggguucgcacugguggccguagcuaucgccugguugcucggauccucuaccagccagaagguuauauaccuggugaugauccugcucauugcgcccgcauauuccaucaggugcauuggcgucucaaaccgggauuuuguggaaggcaugagugggggaacauggguggacgucguuuuagagcacgguggcugugugacuguaauggcccaggauaaaccuaccguggacaucgaacuggucacaaccacggugagcaauauggcugagguucgcucuuacugcuacgaggccuccauaucagauauggcaagcgacagucgauguccaacucaaggggaggcuuaucuugacaagcagucugauacacaguacgugugcaaaagaaccuuggucgacaggggauggggcaacgguugugggcuguucggaaagggcucccuagugacuugcgccaaauuuacaugcagcaagaagaugaccggcaaaucgauucagcccgaaaaucucgaauaucggaucaugcugucuguacacgggucccaacauucaggaaugauuguuaacgaugagaaucgugcgaagguggaagucacgccuaacaguccacgcgccgaggcaacccuugguggcuucgggagccugggauuggacugugagcccagaacaggccucgauuuuuccgaccuguacuauuuaacuaugaauaacaaacacuggcuggugcauaaggaaugguuccacgauaucccucucccauggcacucuggugcugacaccgagacaccgcauuggaauaacaaagaagcccuugucgaguuuaaggaugcucacgccaaaaggcagacugugguugugcuggggagccaggaaggcgcaguacauaccgccuuggcuggagcgcuagaggcagagauggacggcgccaaggggcggcugucaaguggacaccucaagugccgacugaaaauggauaaacuucgccugaagggugucuccuacagcuuguguacagcugccuucaccuuuacuaaggugcccgcagaaacgcuccauggcacaguuaccguggagguccaguaugccgggagagacggaccuugcaaagugccagcucaaauggccguagacaugcagacucugacccccgugggcagguuaaucacagcaaauccuguuauuaccgaaucuacugagaacucaaagaugaugcuggaacuagauccacccuucggugacaguuacauagucaucggggugggcgauaagaaaauuacacaccacuggcaucggagcggauccaucauaggcaaggcguuugaggcuacggugcgcggggccaaaagaauggcaguccucggagacaccgccugggauuucgguucuguuggcgggguguucaacucgcugggaaagggcauucaccagaucuuuggugcugccuucaaaagccuuuuugggggcauguccugguucucacaaaucuugauuggaacucugcucguguggcugggccuuaauacaaagaacgggaguaucucucugaccuguuuggcacucggaggcguaaugauuuuucugagcacagcugucuccgcc

SEQ ID NO: 1869 - RNA, 2070 nt, Artificial Sequence
  KF383120.1 prME-short CDS opt
ggcgccgacaccagcaucgggauuauaggacugcuccuuacaacugcuauggcagccgagaucacgagaagggguuccgcguacuauauguaccuggaucggucugacgcuggcaaggccauuucauucgcaaccacaaugggggugaacaaaugccacguccagaucauggauuugggacauaugugugacgccacuaugaguuaugaaugccccauguuagaugagggcguugaaccugacgauguggacuguuggugcaauaccacaagcaccuggguaguguacgguacuugucaccauaagaaaggggaggcucgcccaucccgacgugcagucacacugccgucucacucgaccagaaagcuacaaacgaggucacagacuuggcucgaaagccgggaguauaccaaacaucugauuaagguggagaacuggauccuucgcaaucccggauuuacaguugccgcucuggccauggcgugguugcucggcaacaguacuucccagagagugauauaccuggucaugauccugcucauugcacccgccuauucuaucaggugcauuggcgugagcaaucgggauuucguagaagggauguccggagguaccuggguugacguggucuuagagcacggcgggugugugacagugauggcucaggauaagccaaccgucgacaucgaacugguuacgacuacagugucaaacauggccgagguacgcaguuacugcuacgaggcaagcauaucugauauggcuuccgacucacgaugucccacccaaggagaagccuaucuugacaaacagagcgauacucaguacgugugcaagagaacauuggucgacaggggcugggguaauggguguggacuguuuggcaaaggcagucuagugaccugcgcgaaguucacgugcucuaaaaagaugaccgggaaguccauucagccugagaaccucgaauaucggaucaugcugagcguucacggaucgcaacauucugguaugauugugaaugauaucggccacgagacagacgaaaaccgugccaaagucgaggugacuccaaauuccccucgcgcagaggcuacccuugggggauuuggcucacuggguuuggauugugaaccuagaacagggcucgacuucagugaucuguacuauuuaacuaugaacaauaagcauuggcugguacacaaagagugguuucacgacaucccacucccguggcaugccggcgcugauaccggaacaccccacuggaacaauaaggaagcccuuguugaguucaaagacgcacaugccaagaggcagaccguggucgugcugggcagccaggaaggggcuguccacacugcguuggcaggagcccuagaggcugagauggauggugccaaaggccggcuguuuuccgggcaucucaagugccgaauuaagauggacaaacugcgccuuaagggagugucuuacagccuguguacggcagccuucacauuuucaaaaguuccugcugaaaccuugcacggcacugugaccguagagguccaguaugccgguagagacgggccaugcaaggugcccgcacaaauggcgguugauaugcagacacucaccccugugggcaggcugauaacugcuaacccaaucauuacagaaaguacggagaacucccggaugauguuagaacuggaucccccguucggagacagcuacaucgucauaggcgugggggacaaaaagauuacccaccauuggcaccgcucuggaucaacuaucgguaaggccuuugaggcaacaguaagaggcgccaaaaggauggcugugcuaggggauaccgccugggacuucggaaguguuggcggugucuucaauagccucgggaagggcgugcaucagguguuuggagcagcuuucaaaucccuguuuggcgggaugucuugguucucgcaaauccuuauuggaacauugcuggucuggcucggccugaacacuaagaaugguagcaucucccuugccugucuggcguugggaggggccaugauuuuucucucaaccgcuguuagugca

SEQ ID NO: 1870 - RNA, 1353 nt, Artificial Sequence; identical to SEQ ID NO: 1645
  KU321639.1 solE CDS opt

SEQ ID NO: 1871 - RNA, 1353 nt, Artificial Sequence; identical to SEQ ID NO: 1646
  KU312312.1 solE CDS opt

SEQ ID NO: 1872 - RNA, 1341 nt, Artificial Sequence; identical to SEQ ID NO: 1647
  AY632535.2 solE CDS opt

SEQ ID NO: 1873 - RNA, 1353 nt, Artificial Sequence; identical to SEQ ID NO: 1646
  KU527068.1 solE CDS opt

SEQ ID NO: 1874 - RNA, 1353 nt, Artificial Sequence
  KX421193.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggaucc

SEQ ID NO: 1875 - RNA, 1353 nt, Artificial Sequence
  LC002520.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaccgugaacgauaucggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggaucc

SEQ ID NO: 1876 - RNA, 1335 nt, Artificial Sequence
  DQ859059.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacgccggggcugacacaggaacuccacacuggaauaacaaagaagcccuuguagaguucaaggacgcgcaugcaaagagacagaccguggucguguugggcucccaggaaggcgccguucacacagcucuggccggggcacuagaggcugaaauggauggagccaaagguaggcucuuuucaggccaucugaagugucggcuuaaaauggacaagcugcgcuugaaaggggugagcuacagucucugcaccgcggccuucacguuuacuaagguccccgcagagacacugcacggaaccgugacuguagagguucaauaugcuggcacagaugguccuuguaaagugccagcccagauggcugucgacaugcagaccuuaacgccgguggggcgacugaucaccgccaaucccgucauuacagaaucuacugagaacuccaagaugaugcucgaacuugauccuccauucggcgacagcuacaucgugauaggaguuggcgauaagaaaauuacccaccauuggcacagaucggggucuacaaucggaaaggcauuugaggccacugugaggggugcuaaacggauggcgguacugggcgacaccgcaugggauuucgggucc

SEQ ID NO: 1877 - RNA, 1341 nt, Artificial Sequence
  KU963573.2 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugagaacagggccaagguggaagucacgcccaauaguccucgggcugaggcaacucugggaggguuuggcagcuugggucucgacugcgagccacgcaccgggcuggauuucucugaccuguacuaccucacaaugaacaauaaacauugguuaguucacaaggaaugguuucaugauauuccccugccuuggcacgccggagcugacacuggcaccccacacuggaacaauaaagaggcccuuguggaguucaaggacgcgcaugcaaagagacagacaguaguggucuugggcucccaggaaggggccgugcacaccgcucuggccggagcacuagaagcugagauggauggugccaaaggcaagcucuuuucagggcaucugaaauguaggcuuaagauggacaaacugcgguugaagggaguuagcuauagucucugcacggcggccuucacuuuuacaaaagugcccgcagagacccugcacggcacugucacaguggaaguacaauacgcugguaccgaugggccuuguaagaucccaguucagauggccguggacaugcagacguuaaccccggucggccgccugauuacagcuaaccccgugaucacugagucuaccgaaaauuccaagaugaugcucgagcuugauccuccauucggagacagcuauauagucauuggcgugggggauaaaaagaucacacaccauuggcaccgaucgggaucuacuauugguaaagccuuugaagcaaccguuagaggcgccaagaggauggcugugcugggggacacagcgugggauuucggaucc

SEQ ID NO: 1878 - RNA, 1353 nt, Artificial Sequence
  KY075939.1 solE CDS opt
agccagaaggugaucuaccuggucaugauucuccuuauagcccccgcuuauucccugagaugcaucggcguuucuaacagggacuucguggaggggaugucaggagguaccuggguagauguggucuuggaacacggcgggugugugacaguuauggcacaagacaaaccuacuguggauauugaguuagucacgaccacagugaguaauauggccgaaguacggagcuacugcuaugaggcguccaucucugacauggcuucggauucacgcuguccaacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauucaaccggagaaucuugaguacagaaucaugcugagcguccauggaucccagcacucagguaugauagugaacgauacaggccaugaaaccgacgagaauagggcuaaggucgaaaucacgcccaacaguccucgggcagaggccacucuagggggauuuggcagccucggucuggauugcgagccacgcaccgggcuggacuucucugaucucuauuacuuaacaaugaauaacaaacacuggcugguucauaaggaaugguuucacgacauuccccuuccuuggcacgcuggagccgacacuggcaccccacauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauccccgcugagaccuuacacggcacugugacagucgaagugcaauaugccgguaccgacgggccuuguaaaguaccagcucagauggccguugauaugcagacgcugaccccggugggccgacucauuacagcaaaucccgucaucacugaguccaccgaaaacagcaagaugaugcuugagcuggacccuccauuuggagauucguacauagugauuggcgucggggaaaagaaaaucacacaucacuggcauagaucuggauccacuauugguaaggccuucgaggcuaccgugaggggcgcgaaacggauggcaguuuugggggacacagccugggauuuuggauca

SEQ ID NO: 1879 - RNA, 1353 nt, Artificial Sequence
  KX447516.1 solE CDS opt
agcaagaaagugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaggacaagccuacuguggauaucgaguuggucacgaccacagugaguaauauggccgaaguacggagcuacugcuaugaggcguccauuucugacauggcuucggauucacgcuguccaacucaaggagaagccuacuuagacaaacagagcgauacccaguauguuugcaagcgaacacugguggaccguggcugggguaacggguguggacuauuuggcaaaggcagucucgugaccugcgcaaaguucgccuguuccaagaaaaugacugggaagucuauccagccggagaaucuggaguacagaauaaugcuuagcguccauggaucccaacacucagguaugaucgugaacgauacaggccaugaaaccgacgagaauagggcuaaagucgaaauuacgcccaacaguccucgggcagaggccacucugggaggguuuggcagcuugggucucgauugcgagccacgcaccgggcuggacuucucugaucuguauuaccucacaaugaauaacaagcacugguuaguucauaaagaaugguuucacgacaucccccugccuuggcacgcuggagccgacacuggcaccccacauuggaauaacaaggaggcgcuuguggaguucaaggaugcacacgccaaaagacagacaguaguggucuugggcucccaggaaggggcugugcauaccgcccuggcaggagcucuagaagccgagauggacggugcgaagggcaggcucucaagcgggcaccugaaaugucggcuuaagauggauaaacugcgcuugaagggaguuaguuacucucucugcacggccgcauuuacuuucacaaaaauucccgcugagacccugcacggcacugugacagucgaagugcaguaugccgguaccgacgggccuuguaagguaccagcucaaauggccguugauaugcagacguuaaccccggugggccgacugaucacagcaaaucccgucauaacugaguccaccgaaaacagcaagaugaugcucgagcuugacccuccauuuggagauucguacauugugaucggcgucggggagaaaaagauuacacaucacuggcauagaucuggauccacuaucgguaaagccuucgaagcuaccgugaggggcgcgaagcggauggcaguucugggggacacagccugggauuuuggauca

SEQ ID NO: 1880 - RNA, 1353 nt, Artificial Sequence
  KX447515.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacugguauagaucuggauccacuaucgguaaggccuucgaggcuaccgugaggggcgcgaaacggauggcaguucugggggacacagccugggauuuuggauca

SEQ ID NO: 1881 - RNA, 1353 nt, Artificial Sequence
  KU758874.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaagcucucaagcgggcaccugaaauguaggcuuaagauggauaaacugcgguugaagggaguuaguuacucucucugcacggccgcauuuacuuucacaaaaauucccgcugagacccugcacggcacugugacagucgaagugcaauaugccgguaccgacgggccuuguaagguaccagcucagauggccguugauaugcagacguuaaccccggugggccgccugaucacagcaaaucccgucauaacugaguccaccgaaaacagcaagaugaugcucgagcuugacccuccauuuggagauucguacauugugaucggcgucggggagaaaaagauuacacaucacuggcaucgaucuggauccacuaucgguaaagccuucgaagcuaccgugagaggcgcgaagaggauggcaguucugggggacacagccugggauuuuggauca

SEQ ID NO: 1882 - RNA, 1353 nt, Artificial Sequence
  KU729218.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauacgcagaccuuaacaccggugggccgacugaucacugcaaaucccgucauaaccgaguccacagaaaacagcaagaugaugcucgagcuugacccuccauuuggagauucguacauugugaucggcgucggggaaaagaaaauuacucaucacuggcauagaucuggauccaccaucgguaaggccuucgaggcuacagugaggggcgcgaaacggauggcaguucugggggacaccgccugggauuuuggauca

SEQ ID NO: 1883 - RNA, 1353 nt, Artificial Sequence
  KU501217.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaauucggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggauca

SEQ ID NO: 1884 - RNA, 1353 nt, Artificial Sequence
  KU761561.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgcggcguauggcaguucugggggacacagccugggauuuuggauca

SEQ ID NO: 1885 - RNA, 1353 nt, Artificial Sequence
  KY075937.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacaugguuucggauucacgcuguccaacucagggagaggcuuacuuagacaagcagagcgauacccaguaugugugcaaacgaacacuggucgaccguggcugggguaacggguguggacuauuuggcaagggcagucucgugaccugcgccaaauucgcauguuccaagaagaugacugggaaaucuauccaaccggaaaaucuggaguacagaauaaugcuuagcgugcauggaucccagcacucagguaugaucgucaacgauacaggccaugaaaccgacgagaauagggccaagguugaaauuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggauca

SEQ ID NO: 1886 - RNA, 1353 nt, Artificial Sequence
  KY014317.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccauugaaaacagcaagaugaugcucgagcuugacccuccauuuggagauucguacaucgugauuggcgucggggaaaagaaaaucacccaucacuggcauagaucuggauccacaaucgguaaggccuucgaggcuacugugaggggcgcgaaacggauggcaguucugggggacaccgccugggauuuuggauca

SEQ ID NO: 1887 - RNA, 1353 nt, Artificial Sequence
  KU870645.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcauuggggaaaagaaaaucacacaucacuggcauagaucuggauccacuaucgguaaggccuucgaggcuaccgucaggggcgcgaaacggauggcagugcugggggacacagccugggauuuuggauca

SEQ ID NO: 1888 - RNA, 1353 nt, Artificial Sequence
  KU922923.1 solE CDS opt
agccagaaggugaucuaccuggucaugauucuccuuauagcccuggcuuauuccaucagaugcauuggcguuucuaacagggacuucguggaggggaugucaggagguaccuggguagauguggucuuggaacacggcgggugugugacaguuauggcacaagacaaacccacuguggauaucgaguuagucacgaccacagugaguaauauggccgaaguacggagcuacugcuaugaggcguccauuucugacauggcuucggauucacgcuguccuacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauccaaccagagaaucuugaguacagaauaaugcugagcguccauggaucccagcacucagguaugaucgugaacgauacaggccaugaaaccgacgagaauagggcuaaggucgaaauuacgccgaacaguccccgggcagaggccacucuagggggauuuggcagccucggucuggauugcgagccucgcaccgggcuggacuucucugaucucuauuacuuaacaaugaauaacaaacacuggcugguucauaaggaaugguuucacgacaucccacuucccuggcacgcuggagccgacacuggcaccccucauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauuccagcugagaccuuacacggcacugugacagucgaagugcaauaugccgguaccgacgggcccuguaaaguaccugcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggauca

SEQ ID NO: 1889 - RNA, 1353 nt, Artificial Sequence
  KU497555.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcacccaggaaggggcugugcauacggcccuggcaggagcucuagaagccgagauggacggugcgaaaggcaggcucuccucagggcaccugaagugucggcuuaaaauggauaagcugcgcuugaaaggaguuagcuacagucucugcacugccgcauuuacauucaccaagauucccgcugagacucugcacggcacagugaccgucgaagugcaauaugccgguacggacgggccuuguaaaguaccagcucagauggccguugauaugcagaccuuaacaccggugggccgacugaucacugcaaaucccgucauaaccgagucuacagaaaacuccaagaugaugcucgagcuugacccuccauuuggagauagcuacauugugaucggcgucggggaaaagaaaauuacucaucacuggcauagaucgggaucuaccaucgguaaggccuucgaggcuacagugaggggcgcgaaacggauggcaguucugggggacaccgccugggauuuuggaucc

SEQ ID NO: 1890 - RNA, 1353 nt, Artificial Sequence
  KU312314.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguauuagcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggauca

SEQ ID NO: 1891 - RNA, 1353 nt, Artificial Sequence
  KY014314.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaagcacacgccaagagacagacaguaguggucuugggcucccaggaaggggcugugcauaccgcccuggcaggagcucuagaggccgagauggauggugcgaaaggcaggcucucaagcgggcaccugaagugucggcuuaaaauggacaagcugcgcuugaaaggaguuaguuacucucucugcacggccgcauuuacuuucacaaagauucccgcugaaacccugcacggcacugugacagucgaggugcaauaugccgguaccgaugggccuuguaaaguaccagcucagauggccguugacaugcagacguuaaccccggugggccgacugaucacagcaaaucccgucauaacugaauccaccgagaacagcaagaugaugcucgaacuugauccuccauuuggagacucguacauugugaucggcgucggggagaagaaaauuacacaucacuggcauagaucuggauccacuaucgguaaggccuucgaggcuaccgugaggggcgcgaaacggauggcaguucugggggauacagccugggacuuuggauca

SEQ ID NO: 1892 - RNA, 1353 nt, Artificial Sequence
  KX447517.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccgcucugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggauca

SEQ ID NO: 1893 - RNA, 1353 nt, Artificial Sequence
  KU729217.2 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucaguacgaccgugagcaauauggccgaaguacgguccuacugcuaugaggcgacaauuucugacaucgcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaaggucgaaaucacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacauuccccugccuuggcacgcuggagccgacacuggcaccccacauuggaauaacaaagaggcgcuuguggaguucaaggaugcacacgccaagagacagacagcuguaguguugggcucccaggaaggggccguccauaccgcacuggcuggagcccuagaagcggagauggacggugccaaaggcaggcucucaagcgggcaccugaagugucggcuuaaaauggauaagcugcgcuugaaaggagugaguuacucucucugcacggcagcuuuuacuuucacaaagauccccgccgagacccugcacggcacuguuacaguggaaguccaauaugcugguaccgacgggccuuguaaagugccagcccagauggcaguagauaugcagacguuaaccccgguuggccgacugauaacagccaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggcuuucgaggcgaccgucaggggcgcaaaacggauggccgugcugggggacacagcuugggauuuuggauca

SEQ ID NO: 1894 - RNA, 1353 nt, Artificial Sequence
  KY328290.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucuccaagauucccgcugagacacugcacggcaccgugacugaagagguccaauaugccgguacagacgggccuuguaaagugccagcucagauggccguagauaugcagaccuuaacgccgguuggccgacugaucaccgcaaaucccgugauaacagaaagcacugagaacucgaagaugaugcucgaacuugacccuccauuuggagauucuuacauugucaucggcgugggggagaagaaaauuacccaucacuggcauagauccggaucaacaaucgguaaggccuucgaggcuacugucaggggcgcgaaacggauggcagugcugggggacaccgccugggauuuuggaagu

SEQ ID NO: 1895 - RNA, 1353 nt, Artificial Sequence
  KX087101.3 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaauuacaauaugccgguaccgacgggccuuguaaagugccagcucagauggccguagauaugcagacgcugaccccgguuggccgacucaucacagcaaaucccgugauaacugaguccaccgaaaacagcaagaugaugcuugagcuggacccuccauuuggagauucguacauugucaucggcgugggggaaaagaaaauuacacaucacuggcauagaucuggauccacuaucgguaaggccuucgaggcuaccgucaggggcgcgaaacggauggcaguguugggggacacagccugggauuuuggauca

SEQ ID NO: 1896 - RNA, 1353 nt, Artificial Sequence
  KY003156.1 solE CDS opt
agccagaaggugaucuaccuggucaugauucuccuuauagcccccgcuuauuccaucagaugcauuggcaucucuaacagggacuucguugaggggaugucaggagguaccuggguggauguagugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcauuuugggucucgauugcgagccacgcaccgggcuggacuucagcgaucuguauuaccucacaaugaauaacaaacacugguuaguccauaaggaaugguuucacgacaucccccugccuuggcacgcuggagccgacacuggcaccccacauuggaauaacaaagaggcgcuuguugaguucaaggaugcacacgccaagagacagacagugguaguguugggcucucaggaaggggcuguccauaccgcccuggcaggagcucuagaagccgagauggacggugcgaaaggcaggcucuccucagggcaccugaagugucggcuuaaaauggauaagcugcgcuugaaaggagugagcuacagucucugcacggccgcauuuacuuucacaaagauacccgcugagacccugcacggcacuguuacaguggaaguccaauaugccgguaccgacgggccuuguaaagugccagcucagauggccguagauaugcagacguuaaccccgguuggccgacugauuacagcaaaucccgugaucacugagucuaccgaaaacuccaagaugaugcucgagcuugacccuccauuuggagauagcuacauugucaucggcgugggggaaaagaaaaucacacaucacuggcauagaucgggaucuacuauugguaaggccuucgaggcuaccgucaggggcgcgaaacggauggcagugcugggggacacagccugggauuuuggaucc

SEQ ID NO: 1897 - RNA, 1353 nt, Artificial Sequence
  KU758876.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacgguguuaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggauca

SEQ ID NO: 1898 - RNA, 1353 nt, Artificial Sequence
  KU926310.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccggugcugacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggauca

SEQ ID NO: 1899 - RNA, 1353 nt, Artificial Sequence
  KU681081.3 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacacuggagcugacaccggcacaccacauuggaauaacaaagaggcccuuguggaguucaaggaugcgcacgcaaagagacagaccguaguggucuugggcucccaggaaggggccgugcauacggcucuggccggagcacuagaagcugagauggacggugccaaaggcaggcucucaagcgggcaccugaagugucggcuuaaaauggauaagcugcgcuugaaaggaguuaguuacucucucugcacugcggccuuuacauucaccaagauucccgcagagacucugcacggcacagugaccgucgaagugcaauaugcugguacggacgggccuuguaaaguaccagcccagauggcuguugauaugcagaccuuaacaccggugggccgacugaucacugccaaucccgucauaaccgagggaacagaaaacuccaagaugaugcucgagcuugacccuccauuuggcgauagcuacauugugaucggggucggagaaaagaaaauuacucaucacuggcauagaucggguucuaccaucggcaaggcauucgaggccacagugaggggagcuaaacggauggcgguucugggggacaccgcaugggauuuuggcucc

SEQ ID NO: 1900 - RNA, 1353 nt, Artificial Sequence
  KU744693.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacagcaauggcccaagacaaaccuacuguugauaucgaguuggugacgaccacagucaguaauauggcggaagugcggagcuacugcuaugaggcuuccauuucugacauggccucggauucacgcuguccaacucagggagaagcauacuuagacaagcagagcgauacccaguauguaugcaaacgaacacugguugaccguggcugggguaacggguguggacuauuuggcaagggcagucucgugaccugcgccaaauucgcuuguuccaagaagaugacugggaaaucuauccaaccggagaaucuggaguacagaauaaugcuuagcguccauggaucccagcacucagguaugcuggugaacgauacaggccaugaaaccgacgagaauagggcaaagguggaaaucacgcccaacaguccucgggccgaggcuacucucgggggauuuggcagcuugggucuggauugcgagccacgcaccgggcuggacuucucugaucucuauuacuuaacaaugaauaacaaacacuggcuggcccauaaggaaugguuucacgacauuccccuuccuuggcacgcgggagcagccacuggcaccccacauuggaauaacaaagaggcuuuggucgaguucaaggacgcccacgcaaagagacagacaguugugguacugggcucccaggaaggggcugugcauaccgcccuagcgggagcccucgaagcagagauggauggugcuaaaggcaggcugucaagcgggcaccuuaagugucggcugaaaauggacaaguugcgccucaaaggagucaguuacucucugugcacggccgcuuuuacuuucacaaagauccccgccgagaccguggauggcacuguuacaguggaaggucaauaugggggcaccgacggaccuuguaaagucccagcacagauggccguggauaugcagacguuaaccccgguaggccgacugauuacagcuaaucccguuaucacugaguccaccgaaaacagcaagaugaugcucgagcuugacccuccauuuggggauucguacauagugauuggagucggugaaaagaaaaucacacaccauuggcacagaucuggcuccacuauugggaaggcguucgaggcaaccgugaggggagccaaacggauggcuguccugggcgacacagccugggauuuugguuca

SEQ ID NO: 1901 - RNA, 1353 nt, Artificial Sequence
  EU545988.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccugccguggauaucgaguuggucacuacgaccgugaguaauauggcggaaguacggagcuacugcuaugaggcuuccauuucugacauggccucggauucacgcuguccaacacagggagaagcauacuuagacaagcagagcgauacucaguauguuugcaaacgaacccugguggaccguggcugggguaacggguguggacuauuuggcaagggcagucucgucacaugcgccaaauucgcuuguuccaagaagaugaccgggaaaucuauccaaccggagaaucuggaguacagaauaaugcuuagcgugcauggaucccagcacucagguaugaucgugaacgauacuggccaugaaacagacgagaauagggcaaaggucgaaauuacccccaacaguccucgggccgaggcuacgcugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggauca

SEQ ID NO: 1902 - RNA, 1353 nt, Artificial Sequence
  KY007221.1 solE CDS opt
agccagaaggugaucuaccuggucaugauucuccuuauagcccccgcuuauuccaucagaugcauuggcguuaacaauagggacuucguggaggggaugucuggagguaccuggguagaugugguccuggaacacggcgggugugugacaguuauggcacaagacaaaccuacuguggauaucgaguuggucacgaccacagugucaaacauggccgaaguacggaguuacugcuaugaggcgagcauuuccgacauggcuucugauucgcgcuguccaacucagggagaagccuacuuagacaagcagucagauacccaguauguuugcaaacgaacacugguggaccguggcugggguaauggguguggacuauuuggcaagggcagccucgugaccugcgcaaaauucgccuguaguaagaagaugacugggaaauccauccaaccggagaaccuggaguacagaauaaugcuuucuguccauggaagccagcacuccgguaugaucgugaaugauacaggccaugaaaccgacgagaacagggcuaaggucgaaauuacgcccaauucaccucgggcagaggccacucugggaggguuuggcaguuugggucucgauugcgagccacgcaccgggcuggacuucagcgaucuguauuaccucacaaugaacaauaaacacugguuaguucauaaggaaugguuucacgacaucccccugccuuggcacgcuggagccgacacuggcaccccacauuggaacaauaaagaggcgcuuguggaguucaaggaugcacacgccaagagacagacaguaguggucuugggcucucaggaaggggcugugcauaccgcccuggcaggagcucuagaagccgagauggacggugcgaaaggcaggcucuccucagggcaccugaagugucggcuuaaaauggauaagcugcgcuugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaccccgucauaacugagucuaccgaaaauuccaagaugaugcucgagcuugacccuccauuuggagauagcuacauugugaucggcgucggggaaaagaaaauuacacaucacuggcauagaucgggaucuacuaucgguaaggccuucgaggcuaccgugaggggcgcgaaacggauggcaguucugggggacacagccugggauuuuggaucc

SEQ ID NO: 1903 - RNA, 1353 nt, Artificial Sequence
  KY003152.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcgccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggauca

SEQ ID NO: 1904 - RNA, 1353 nt, Artificial Sequence
  KX694533.2 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauauuggccaugaaacagacgagaauagggcuaaggucgaaaucacccccaacaguccucgggcagaggccacgcugggaggguuuggcagcuugggucucgauugcgagccacgcacugggcuggacuucucugaucuguauuaccucaccaugaauaacaaacacugguuaguucauaaggaaugguuucacgacauuccccugccuuggcacgcuggagccgacacaggcacuccacauuggaauaacaaagaggcgcuuguggaguucaaggaugcacacgccaagagacagaccguaguggucuugggcucccaggaaggggcugugcauacagcccuggcaggagcucuagaagccgagauggacggugcgaaaggcaggcucucaagcgggcaccugaagugucggcuuaaaauggauaagcugcgcuugaaaggaguuaguuacucucucugcaccgccgcauuuacguucacuaagauccccgcugagacacugcacggcaccgugacugucgaagugcaauaugccgguacagacgggccuuguaaaguaccagcucagauggccguugauaugcagaccuuaacgccggugggccgacugauaaccgcaaaucccgucauuacagaguccacugaaaacagcaagaugaugcucgagcuugacccuccauuuggagauucguacaucgugauuggcgucggggacaagaaaaucacccaucacuggcauagaucuggauccacaaucgguaaggccuucgaagcuacugugaggggcgcgaaacggauggcaguucugggggauaccgccugggacuuuggauca

SEQ ID NO: 1905 - RNA, 1353 nt, Artificial Sequence
  KX601167.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggacaagaaaauuacacaucacugguauagaucuggauccacuaucgguaaggccuucgaagcuaccgugaggggcgcgaaacggauggcaguucugggggauacagccugggacuuuggauca

SEQ ID NO: 1906 - RNA, 1353 nt, Artificial Sequence
  KY288905.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggccaugaaacggacgagaauagggccaaggucgaaguuacucccaacaguccucgggcugaggcaacccugggaggguuuggcagcuugggucucgauugcgagccacgcacagggcuggacuucucugaucuguauuaccucacuaugaauaacaaacacugguuagugcauaaggaaugguuucacgacauuccccugccuuggcacgccggagcugacaccggcacaccacauuggaauaacaaagaggcccuuguagaguucaaggaugcgcacgcaaagagacagaccguggucguguugggcucccaggaaggggccguucauacggcucuggccggagcacuagaagcugagauggacggugccaaaggcaggcucuuuucagggcaccugaagugucggcuuaaaauggauaagcugcgcuugaaaggagugagcuacagucucugcacugcggccuucacauuuaccaagguccccgcagagacucugcacggcacagugaccguagaaguucaauaugcugguacggacgggccuuguaaagugccagcccagauggcugucgauaugcagaccuuaacaccggugggccgacugaucacugccaaucccgucauuaccgagucuacagaaaacuccaagaugaugcucgagcuugacccuccauucggagauagcuacaucgugauaggcguuggggacaagaaaauuacucaucacuggcauagaucgggaucuaccaucgguaaggcauuugaagccacagugaggggcgcuaaacggauggcgguacugggggauaccgcaugggacuucggaucc

SEQ ID NO: 1907 - RNA, 1353 nt, Artificial Sequence
  KF268950.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggccuucacuuuuacaaagguccccgcagagacccugcacggcacugugacaguagaaguucaauaugcugguaccgacgggccuuguaaagugccagcccagauggcugucgauaugcagacguuaaccccggugggccgacugauuacagccaaucccgucaucacugagucuaccgaaaacuccaagaugaugcucgagcuugacccuccauucggagauagcuacauagugauuggcguuggggacaagaaaaucacacaucacuggcauagaucgggaucuacuauugguaaggcauuugaagccaccgugaggggcgcuaaacggauggcgguacugggggauacagcaugggacuucggaucc

SEQ ID NO: 1908 - RNA, 1353 nt, Artificial Sequence
  KF383116.1 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggucuguacugccgcaaaggugcccgcugagacacugcacggcaccguaacuguugaagugcaauaugccgguacagacgggccuugcaaagucccagcucagauggccguggauaugcagaccuuaacgccggucggccgacugauuaccgcaaaucccgugaucacagagucuacugaaaacuccaagaugaugcucgagcuugacccuccauucggagauagcuacauaguuauuggcgugggggacaagaaaaucacccaucacuggcauagaucgggaucuacaauugguaaggccuuugaagcuacuguaaggggcgcgaaacggauggcaguccugggggauaccgccugggacuucggaucc

SEQ ID NO: 1909 - RNA, 1335 nt, Artificial Sequence
  KU963574.2 solE CDS opt
agccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacuccggggccgacacagaaacuccacacuggaauaacaaagaggcucuuguagaguucaaggacgcccaugcgaagagacagaccguggucguguugggaucacaggaaggcgcaguucacacagcccuggcuggcgcccuagaagcagagauggauggggcuaaaggaaggcucagcaguggucaucugaagugucggcuuaaaauggacaagcugcgcuugaaaggcgugucuuacucccucugcaccgccgcguuuacguucacuaagguccccgccgagacacugcacgggaccgugacuguagaaguucaauaugcaggacgagauggcccuuguaaagugccagcucagauggccgucgacaugcagacauuaaccccgguggguagacugaucacggcuaaucccgucauuaccgagagcacagaaaacucgaagaugaugcucgagcuugauccuccauuuggggacucuuacaucgugauaggcguuggagauaagaaaauuacucaccauuggcacagguccggcucaaucauugggaaggccuucgaagcaaccgugcggggagccaaacguauggcuguacugggugacacagcgugggauuuuggcagu

SEQ ID NO: 1910 - RNA, 1353 nt, Artificial Sequence
  KF383118.1 solE CDS opt
agccagaaggugaucuaccuggucaugauuguucucauagugcccgccuauuccaucucuugcauuggcguaucaaacagagaccuuguggaggggaugaguggagguaccugggucgaugugguucuggaacacggcgggugugugacagagauggcucaagacaaaccuacugucgauaucgaauuggugacgaugaccguaagcaauauggcagagguuagguccuacugcuaugaagccucuuuaucggacauggcgucagcuagccgguguccaacacagggagagccgagucuggauaagcaguccgacacucagucugugugcaaacgcacccuaggcgaucgagguugggggaacggauguggcauuuucggcaaggggagccucgucacaugcuccaaauuuaccuguugcaagaagaugcccggaaaaucaauccaaccugagaaucuggaauaccguauaaugcuuccagugcaugguagucagcacagcggcaugaucgugaacgacauugggcaugagacugaugaaaauagagccaaggucgagguuacacccaacucuccuagggcagaggccacccugggaggcuucgguuccuuggggcucgacugugaaccacggacgggacuggauuuuucagaccuguauuaccucacuaugaauaacaaacacugguuagugcauaaggagugguuccacgauaucccccugccuuggcacgcuggcgcagacaccggcacaccacauuggaauaacaaagaagcccuuguagaguuuaaggacgcucacgccaagcgccagacuguggucguguuggggagccaggaaggagcgguucauaccgcacuggccggugcucuagaggccgagauggauggcgcaaaagggagacucuucaguggacaccugaagugcaggcuuaaaauggacaagcugcgguugaaaggcgugucuuauucccucuguacagcugccuuuaccuucacgaaggucccggcggaaacucugcacgguacagugaccguagagguucaaagcgccgggacugauggccccugcaaagugccugcacagauggcugucgacaugcagacauuaaccccagugggacgccugauuacggccaaucccgucaucaccgaaucgacagagaacucuaagaugaugcucgaacuugauccuccauuuggcgacuccuacauagugauugggguuggagauaagaaaaucacucaucacuggcaucgaucagguaguaccauuggcaaggcuuucgaggccacagugagaggggcaaaaaggauggccguacugggagacacugcuugggauuuuggcagc

SEQ ID NO: 1911 - RNA, 1353 nt, Artificial Sequence
  KX520666.1 solE CDS opt
agacagaaggugaucuaccuggucaugauucuccuuauagcccccgcuuauagcaucaggugcauuggcguuuccaaccgggacuucguggaggggaugucuggagguaccuggguagaugugguccuggaacacggcgggugugugacaguuauggcacaagacaaaccuacuguggauaucgaguuggucacgaccacagugucaaauauggccgaaguacgcaguuacugcuaugaggcgagcauuuccgacauggcuucugauucgcgauguccaacucagggagaagccuacuuagacaagcagucagauacccaguauguuugcaaacguacacugguggacagaggcugggguaacggguguggacuauuuggcaagggcagccucgugaccugcgcaaaauucgccuguaguaagaagaugacugggaaauccauccaaccggagaaucuggaguacaggauaaugcuuucuguccauggaagccagcacuccgguaugaucgugaacgauacaggccaugaaaccgacgagaaucgggcuaaggucgaaauuacgcccaacucaccucgcgcagaggccacucugggaggguuuggcaguuugggucucgauugcgagccaagaaccgggcuggacuucagcgaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagaggcagacaguaguggucuugggcucucaggaaggggcugugcauaccgcccuggcaggagcucuagaagccgagauggacggugcgaaaggccggcucuccucagggcaccugaagugucgccuuaaaauggauaagcugcgauugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggcagacugaucacagcaaaucccgucauaacugagucuaccgaaaacuccaagaugaugcucgagcuugacccuccauuuggagauagcuacauugugaucggcgucggggaaaagaaaauuacacaucacuggcauaggucgggaucuacuaucgguaaggccuucgaggcuaccgugcggggcgcgaaacguauggcaguucugggggacacagccugggauuuuggaucc

SEQ ID NO: 1912 - RNA, 1353 nt, Artificial Sequence
  KF383120.1 solE CDS opt
agccagagagugaucuaccuggucaugauucuccuuauagcccccgcuuauuccaucaggugcauuggcguuucuaaccgggacuucguggaggggaugucaggagguaccuggguagaugugguccuggaacacggcgggugugugacaguuauggcacaagacaagccuacuguggauaucgaguuggucacgaccacagugaguaauauggccgaaguacgcagcuacugcuaugaggcguccauuucugacauggcuucggauucacgauguccaacucagggagaagccuacuuagacaaacagagcgauacccaguauguuugcaagcguacacugguggacagaggcugggguaacggguguggacuauuuggcaaaggcagucucgugaccugcgcaaaguucacuuguuccaaaaagaugacagggaagucuauccaaccggagaaucuggaguacaggauaaugcuuagcguccauggaucccagcacucagguaugaucgugaacgauauuggccaugaaaccgacgagaaucgggccaaagucgaaguuacgcccaacaguccucgcgcugaggcaacucugggaggguuuggcagcuugggucucgauugcgagccaagaaccgggcuggacuucucugaucuguauuaccucacaaugaauaacaagcacugguuagugcauaaagaaugguuucacgacaucccccugccuuggcacgccggagcugacacuggcaccccacauuggaauaacaaggaggcccuuguagaguucaaagaugcgcacgcaaagaggcagacaguggucguguugggcucccaggaaggggccguucauaccgcucuggccggagcacuagaagcugagauggacggugccaagggccggcucuuuucagggcaccugaaaugucgcauuaagauggauaaacuucgacugaagggagugagcuacaguuugugcacggcggccuucacuuuuucuaaaguccccgcagagacacuccacggcaccgugacuguagaaguucaauaugcugguagagacgggccuuguaaggugccagcccagauggcugucgauaugcagacacugaccccggugggcagguuaaucacggccaaucccauaauuaccgaguccacagaaaacagccggaugaugcuggagcucgacccuccauucggagauucguacaucgucauuggcgugggggacaaaaagaucacucaucacuggcaucguucuggauccaccaucgguaaggcauuugaagccacaguucgcggcgcuaaaagaauggcggugcuuggggauacugcaugggacuucggauca

SEQ ID NO: 1913 - RNA, 2136 nt, Artificial Sequence
  ZIKV (strain ZikaSPH2015) Polyprotein(93-804) CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1914 - RNA, 2136 nt, Artificial Sequence
  ZIKV (isolate Z1106033) Polyprotein(93-804) CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaag

SEQ ID NO: 1915 - RNA, 2124 nt, Artificial Sequence
  ZIKV (strain MR 766) Polyprotein(93-800) CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 1916 - RNA, 2136 nt, Artificial Sequence
  ZIKV (strain NatalRGN) Polyprotein(93-804) CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1917 - RNA, 2061 nt, Artificial Sequence
  ZIKV (strain ZikaSPH2015) Polyprotein(108-794) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1918 - RNA, 2061 nt, Artificial Sequence
  ZIKV (isolate Z1106033) Polyprotein(108-794) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 1919 - RNA, 2049 nt, Artificial Sequence
  ZIKV (strain MR 766) Polyprotein(108-790) CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 1920 - RNA, 2061 nt, Artificial Sequence
  ZIKV (strain NatalRGN) Polyprotein(108-794) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1921 - RNA, 1353 nt, Artificial Sequence
  ZIKV (strain ZikaSPH2015) Polyprotein(273-723) CDS opt
agccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 1922 - RNA, 1353 nt, Artificial Sequence
  ZIKV (isolate Z1106033) Polyprotein(273-723) CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 1923 - RNA, 1341 nt, Artificial Sequence
  ZIKV (strain MR 766) Polyprotein(273-719) CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 1924 - RNA, 1353 nt, Artificial Sequence; identical to SEQ ID NO: 1922
  ZIKV (strain NatalRGN) Polyprotein(273-723) CDS opt

SEQ ID NO: 1925 - RNA, 2061 nt, Artificial Sequence
  ZIKV (strain ZikaSPH2015) Polyprotein(108-794)(F398S) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1926 - RNA, 2061 nt, Artificial Sequence
  ZIKV (isolate Z1106033) Polyprotein(108-794)(F398S) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 1927 - RNA, 2049 nt, Artificial Sequence
  ZIKV (strain MR 766) Polyprotein(108-790)(F398S) CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 1928 - RNA, 2061 nt, Artificial Sequence
  ZIKV (strain NatalRGN) Polyprotein(108-794)(F398S) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1929 - RNA, 2061 nt, Artificial Sequence
  ZIKV (strain ZikaSPH2015) Polyprotein(108-794)(N444Q) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1930 - RNA, 2061 nt, Artificial Sequence
  ZIKV (isolate Z1106033) Polyprotein(108-794)(N444Q) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 1931 - RNA, 2061 nt, Artificial Sequence
  ZIKV (strain NatalRGN) Polyprotein(108-794)(N444Q) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1932 - RNA, 2061 nt, Artificial Sequence
  ZIKV (strain ZikaSPH2015) Polyprotein(108-694)-Cterm-JAEV1-E(400-500) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 1933 - RNA, 2061 nt, Artificial Sequence
  ZIKV (isolate Z1106033) Polyprotein(108-694)-Cterm-JAEV1-E(400-500) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 1934 - RNA, 2049 nt, Artificial Sequence
  ZIKV (strain MR 766) Polyprotein(108-690)-Cterm-JAEV1-E(400-500) CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 1935 - RNA, 2061 nt, Artificial Sequence
  ZIKV (strain NatalRGN) Polyprotein(108-694)-Cterm-JAEV1-E(400-500) CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 1936 - RNA, 2136 nt, Artificial Sequence; identical to SEQ ID NO: 1913
  ZIKV (strain ZikaSPH2015) Polyprotein(93-804) CDS opt

SEQ ID NO: 1937 - RNA, 2133 nt, Artificial Sequence
  ZIKV prME variant CDS opt
aucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1938 - RNA, 2130 nt, Artificial Sequence
  ZIKV prME variant CDS opt
aucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1939 - RNA, 2127 nt, Artificial Sequence
  ZIKV prME variant CDS opt
aacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1940 - RNA, 2124 nt, Artificial Sequence
  ZIKV prME variant CDS opt
gccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1941 - RNA, 2121 nt, Artificial Sequence
  ZIKV prME variant CDS opt
agaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1942 - RNA, 2118 nt, Artificial Sequence
  ZIKV prME variant CDS opt
aaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1943 - RNA, 2115 nt, Artificial Sequence
  ZIKV prME variant CDS opt
gagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1944 - RNA, 2112 nt, Artificial Sequence
  ZIKV prME variant CDS opt
aagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1945 - RNA, 2109 nt, Artificial Sequence
  ZIKV prME variant CDS opt
aagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1946 - RNA, 2106 nt, Artificial Sequence
  ZIKV prME variant CDS opt
agaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1947 - RNA, 2103 nt, Artificial Sequence
  ZIKV prME variant CDS opt
agaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1948 - RNA, 2100 nt, Artificial Sequence
  ZIKV prME variant CDS opt
ggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1949 - RNA, 2097 nt, Artificial Sequence
  ZIKV prME variant CDS opt
gccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1950 - RNA, 2094 nt, Artificial Sequence
  ZIKV prME variant CDS opt
gacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1951 - RNA, 2091 nt, Artificial Sequence
  ZIKV prME variant CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1952 - RNA, 2091 nt, Artificial Sequence
  ZIKV prME variant CDS opt
accagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1953 - RNA, 2103 nt, Artificial Sequence
  ZIKV prME variant CDS opt
agaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1954 - RNA, 2127 nt, Artificial Sequence
  ZIKV prME variant CDS opt
agaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1955 - RNA, 2127 nt, Artificial Sequence
  ZIKV prME variant CDS opt
agaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 1956 - RNA, 2118 nt, Artificial Sequence
  ZIKV prME variant CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1957 - RNA, 2115 nt, Artificial Sequence
  ZIKV prME variant CDS opt
aucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1958 - RNA, 2112 nt, Artificial Sequence
  ZIKV prME variant CDS opt
aucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1959 - RNA, 2109 nt, Artificial Sequence
  ZIKV prME variant CDS opt
aacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1960 - RNA, 2106 nt, Artificial Sequence
  ZIKV prME variant CDS opt
gccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1961 - RNA, 2103 nt, Artificial Sequence
  ZIKV prME variant CDS opt
agaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1962 - RNA, 2100 nt, Artificial Sequence
  ZIKV prME variant CDS opt
aaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1963 - RNA, 2097 nt, Artificial Sequence
  ZIKV prME variant CDS opt
gagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1964 - RNA, 2094 nt, Artificial Sequence
  ZIKV prME variant CDS opt
aagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1965 - RNA, 2091 nt, Artificial Sequence
  ZIKV prME variant CDS opt
aagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1966 - RNA, 2088 nt, Artificial Sequence
  ZIKV prME variant CDS opt
agaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1967 - RNA, 2085 nt, Artificial Sequence
  ZIKV prME variant CDS opt
agaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1968 - RNA, 2082 nt, Artificial Sequence
  ZIKV prME variant CDS opt
ggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1969 - RNA, 2079 nt, Artificial Sequence
  ZIKV prME variant CDS opt
gccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1970 - RNA, 2076 nt, Artificial Sequence
  ZIKV prME variant CDS opt
gacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1971 - RNA, 2073 nt, Artificial Sequence
  ZIKV prME variant CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1972 - RNA, 2073 nt, Artificial Sequence
  ZIKV prME variant CDS opt
accagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1973 - RNA, 2085 nt, Artificial Sequence
  ZIKV prME variant CDS opt
agaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1974 - RNA, 2109 nt, Artificial Sequence
  ZIKV prME variant CDS opt
agaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1975 - RNA, 2109 nt, Artificial Sequence
  ZIKV prME variant CDS opt
agaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugc

SEQ ID NO: 1976 - RNA, 2109 nt, Artificial Sequence
  ZIKV prME variant CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1977 - RNA, 2106 nt, Artificial Sequence
  ZIKV prME variant CDS opt
aucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1978 - RNA, 2103 nt, Artificial Sequence
  ZIKV prME variant CDS opt
aucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1979 - RNA, 2100 nt, Artificial Sequence
  ZIKV prME variant CDS opt
aacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1980 - RNA, 2097 nt, Artificial Sequence
  ZIKV prME variant CDS opt
gccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1981 - RNA, 2094 nt, Artificial Sequence
  ZIKV prME variant CDS opt
agaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1982 - RNA, 2091 nt, Artificial Sequence
  ZIKV prME variant CDS opt
aaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1983 - RNA, 2088 nt, Artificial Sequence
  ZIKV prME variant CDS opt
gagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1984 - RNA, 2085 nt, Artificial Sequence
  ZIKV prME variant CDS opt
aagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1985 - RNA, 2082 nt, Artificial Sequence
  ZIKV prME variant CDS opt
aagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1986 - RNA, 2079 nt, Artificial Sequence
  ZIKV prME variant CDS opt
agaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1987 - RNA, 2076 nt, Artificial Sequence
  ZIKV prME variant CDS opt
agaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1988 - RNA, 2073 nt, Artificial Sequence
  ZIKV prME variant CDS opt
ggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1989 - RNA, 2070 nt, Artificial Sequence
  ZIKV prME variant CDS opt
gccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1990 - RNA, 2067 nt, Artificial Sequence
  ZIKV prME variant CDS opt
gacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1991 - RNA, 2064 nt, Artificial Sequence
  ZIKV prME variant CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1992 - RNA, 2064 nt, Artificial Sequence
  ZIKV prME variant CDS opt
accagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1993 - RNA, 2076 nt, Artificial Sequence
  ZIKV prME variant CDS opt
agaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1994 - RNA, 2100 nt, Artificial Sequence
  ZIKV prME variant CDS opt
agaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1995 - RNA, 2100 nt, Artificial Sequence
  ZIKV prME variant CDS opt
agaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgac

SEQ ID NO: 1996 - RNA, 2106 nt, Artificial Sequence
  ZIKV prME variant CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1997 - RNA, 2100 nt, Artificial Sequence
  ZIKV prME variant CDS opt
aucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1998 - RNA, 2103 nt, Artificial Sequence
  ZIKV prME variant CDS opt
aucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 1999 - RNA, 2097 nt, Artificial Sequence
  ZIKV prME variant CDS opt
aacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2000 - RNA, 2094 nt, Artificial Sequence
  ZIKV prME variant CDS opt
gccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2001 - RNA, 2091 nt, Artificial Sequence
  ZIKV prME variant CDS opt
agaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2002 - RNA, 2088 nt, Artificial Sequence
  ZIKV prME variant CDS opt
aaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2003 - RNA, 2085 nt, Artificial Sequence
  ZIKV prME variant CDS opt
gagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2004 - RNA, 2082 nt, Artificial Sequence
  ZIKV prME variant CDS opt
aagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2005 - RNA, 2079 nt, Artificial Sequence
  ZIKV prME variant CDS opt
aagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2006 - RNA, 2076 nt, Artificial Sequence
  ZIKV prME variant CDS opt
agaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2007 - RNA, 2073 nt, Artificial Sequence
  ZIKV prME variant CDS opt
agaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2008 - RNA, 2070 nt, Artificial Sequence
  ZIKV prME variant CDS opt
ggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2009 - RNA, 2067 nt, Artificial Sequence
  ZIKV prME variant CDS opt
gccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2010 - RNA, 2064 nt, Artificial Sequence
  ZIKV prME variant CDS opt
gacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2011 - RNA, 2061 nt, Artificial Sequence; identical to SEQ ID NO: 1917
  ZIKV (strain ZikaSPH2015) Polyprotein(108-794) CDS opt

SEQ ID NO: 2012 - RNA, 2061 nt, Artificial Sequence
  ZIKV prME variant CDS opt
accagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2013 - RNA, 2073 nt, Artificial Sequence
  ZIKV prME variant CDS opt
agaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2014 - RNA, 2097 nt, Artificial Sequence
  ZIKV prME variant CDS opt
agaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2015 - RNA, 2097 nt, Artificial Sequence
  ZIKV prME variant CDS opt
agaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2016 - RNA, 2136 nt, Artificial Sequence; identical to SEQ ID NO: 1913
  KU321639.1 prME-long CDS opt

SEQ ID NO: 2017 - RNA, 2136 nt, Artificial Sequence; identical to SEQ ID NO: 1914
  KU312312.1 prME-long CDS opt

SEQ ID NO: 2018 - RNA, 2124 nt, Artificial Sequence; identical to SEQ ID NO: 1915
  AY632535.2 prME-long CDS opt

SEQ ID NO: 2019 - RNA, 2136 nt, Artificial Sequence; identical to SEQ ID NO: 1916
  KU527068.1 prME-long CDS opt

SEQ ID NO: 2020 - RNA, 2136 nt, Artificial Sequence
  KU720415.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2021 - RNA, 2118 nt, Artificial Sequence
  DQ859059.1 prME-long CDS opt
agaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2022 - RNA, 2136 nt, Artificial Sequence
  KX377335.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2023 - RNA, 2136 nt, Artificial Sequence
  LC002520.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2024 - RNA, 2124 nt, Artificial Sequence
  KU963573.2 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2025 - RNA, 2136 nt, Artificial Sequence
  KX694534.2 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2026 - RNA, 2136 nt, Artificial Sequence
  KX447520.1 prME-long CDS opt
agaaucaucaacgccagaaaggagaagaagagaagaggcgccgacgccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2027 - RNA, 2136 nt, Artificial Sequence
  KX369547.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2028 - RNA, 2136 nt, Artificial Sequence
  KX447515.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2029 - RNA, 2136 nt, Artificial Sequence
  KU501217.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2030 - RNA, 2136 nt, Artificial Sequence
  KU312314.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2031 - RNA, 2136 nt, Artificial Sequence
  KX446950.2 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2032 - RNA, 2136 nt, Artificial Sequence
  KY003157.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccgacgugggcugcagcguggacuucagcaag

SEQ ID NO: 2033 - RNA, 2136 nt, Artificial Sequence
  KX811222.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2034 - RNA, 2136 nt, Artificial Sequence
  KX447516.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2035 - RNA, 2136 nt, Artificial Sequence
  KX520666.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2036 - RNA, 2136 nt, Artificial Sequence
  KU729218.1 prME-long CDS opt
agaaucaucaacgccagaaaggagaagaagagaagaagcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2037 - RNA, 2136 nt, Artificial Sequence
  KU761561.1 prME-long CDS opt
agaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2038 - RNA, 2136 nt, Artificial Sequence
  KY317938.1 prME-long CDS opt
agaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2039 - RNA, 2136 nt, Artificial Sequence
  KY075939.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2040 - RNA, 2136 nt, Artificial Sequence
  KX806557.2 prME-long CDS opt
agaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2041 - RNA, 2136 nt, Artificial Sequence
  KU870645.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2042 - RNA, 2136 nt, Artificial Sequence
  KU729217.2 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2043 - RNA, 2136 nt, Artificial Sequence
  KU497555.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2044 - RNA, 2136 nt, Artificial Sequence
  KX087101.3 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2045 - RNA, 2136 nt, Artificial Sequence
  KY075932.1 prME-long CDS opt
agaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2046 - RNA, 2136 nt, Artificial Sequence
  KY014317.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2047 - RNA, 2136 nt, Artificial Sequence
  KU758876.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccgacgugggcugcagcguggacuucagcaag

SEQ ID NO: 2048 - RNA, 2136 nt, Artificial Sequence
  KU758874.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2049 - RNA, 2136 nt, Artificial Sequence
  KY014314.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2050 - RNA, 2136 nt, Artificial Sequence
  KU926310.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2051 - RNA, 2136 nt, Artificial Sequence
  KU761560.1 prME-long CDS opt
agaaucaucaacgccggcaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2052 - RNA, 2136 nt, Artificial Sequence
  KY317939.1 prME-long CDS opt
agaaucaucaacgccagaaaggagaagaagagaagaggcgccgagaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2053 - RNA, 2136 nt, Artificial Sequence
  KY075937.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2054 - RNA, 2136 nt, Artificial Sequence
  LC191864.1 prME-long CDS opt
agaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2055 - RNA, 2136 nt, Artificial Sequence
  KX447517.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2056 - RNA, 2136 nt, Artificial Sequence
  KU922923.1 prME-long CDS opt
agaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2057 - RNA, 2136 nt, Artificial Sequence
  KY003156.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2058 - RNA, 2136 nt, Artificial Sequence
  KU312313.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaag

SEQ ID NO: 2059 - RNA, 2136 nt, Artificial Sequence
  KY075935.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2060 - RNA, 2136 nt, Artificial Sequence
  KY014320.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2061 - RNA, 2136 nt, Artificial Sequence
  KX827309.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2062 - RNA, 2136 nt, Artificial Sequence
  KU681081.3 prME-long CDS opt
agaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2063 - RNA, 2136 nt, Artificial Sequence
  KU744693.1 prME-long CDS opt
agaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcggcgugggcugcagcguggacuucagcaag

SEQ ID NO: 2064 - RNA, 2136 nt, Artificial Sequence
  KY328290.1 prME-long CDS opt
agaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2065 - RNA, 2136 nt, Artificial Sequence
  KX694532.2 prME-long CDS opt
agaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2066 - RNA, 2136 nt, Artificial Sequence
  KU955593.1 prME-long CDS opt
agaaucaucaacgccagaaaggagaagaagagaagaggcaccgacaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccgacgugggcugcagcguggacuucagcaag

SEQ ID NO: 2067 - RNA, 2136 nt, Artificial Sequence
  KY272987.1 prME-long CDS opt
agaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccgacgugggcugcagcguggacuucagcaag

SEQ ID NO: 2068 - RNA, 2136 nt, Artificial Sequence
  EU545988.1 prME-long CDS opt
agaaucaucaacgccagaaaggagaagaagagaagaggcaccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaag

SEQ ID NO: 2069 - RNA, 2136 nt, Artificial Sequence
  KU681082.3 prME-long CDS opt
agaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaag

SEQ ID NO: 2070 - RNA, 2136 nt, Artificial Sequence
  KX601167.1 prME-long CDS opt
agaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaag

SEQ ID NO: 2071 - RNA, 2136 nt, Artificial Sequence
  KX694533.2 prME-long CDS opt
agaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaag

SEQ ID NO: 2072 - RNA, 2136 nt, Artificial Sequence
  KY288905.1 prME-long CDS opt
agaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2073 - RNA, 2136 nt, Artificial Sequence
  KF268950.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2074 - RNA, 2136 nt, Artificial Sequence
  KF383121.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2075 - RNA, 2118 nt, Artificial Sequence
  KF268949.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2076 - RNA, 2136 nt, Artificial Sequence
  KU955595.1 prME-long CDS opt
agaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2077 - RNA, 2136 nt, Artificial Sequence
  KF383116.1 prME-long CDS opt
agaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2078 - RNA, 2118 nt, Artificial Sequence
  KU963574.2 prME-long CDS opt
agaaucaucaacgccagaaaggagagaaagagaagaggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2079 - RNA, 2118 nt, Artificial Sequence
  KX601166.1 prME-long CDS opt
agaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2080 - RNA, 2136 nt, Artificial Sequence
  KF383118.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaag

SEQ ID NO: 2081 - RNA, 2130 nt, Artificial Sequence
  KF383120.1 prME-long CDS opt
agaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccgacgugggcugcagcguggacuuc

SEQ ID NO: 2082 - RNA, 2061 nt, Artificial Sequence; identical to SEQ ID NO: 1917
  KU321639.1 prME-short CDS opt

SEQ ID NO: 2083 - RNA, 2061 nt, Artificial Sequence; identical to SEQ ID NO: 1918
  KU312312.1 prME-short CDS opt

SEQ ID NO: 2084 - RNA, 2049 nt, Artificial Sequence; identical to SEQ ID NO: 1919
  AY632535.2 prME-short CDS opt

SEQ ID NO: 2085 - RNA, 2061 nt, Artificial Sequence; identical to SEQ ID NO: 1920
  KU527068.1 prME-short CDS opt

SEQ ID NO: 2086 - RNA, 2061 nt, Artificial Sequence
  KX421193.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2087 - RNA, 2061 nt, Artificial Sequence
  KX377335.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2088 - RNA, 2061 nt, Artificial Sequence
  LC002520.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2089 - RNA, 2043 nt, Artificial Sequence
  DQ859059.1 prME-short CDS opt
accagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2090 - RNA, 2049 nt, Artificial Sequence
  KU963573.2 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2091 - RNA, 2061 nt, Artificial Sequence
  KX694534.2 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2092 - RNA, 2061 nt, Artificial Sequence
  KX369547.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2093 - RNA, 2061 nt, Artificial Sequence
  KX447515.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2094 - RNA, 2061 nt, Artificial Sequence
  KU729218.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2095 - RNA, 2061 nt, Artificial Sequence
  KU501217.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2096 - RNA, 2061 nt, Artificial Sequence
  KU312314.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2097 - RNA, 2061 nt, Artificial Sequence
  KX446950.2 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2098 - RNA, 2061 nt, Artificial Sequence
  KY003157.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgcc

SEQ ID NO: 2099 - RNA, 2061 nt, Artificial Sequence
  KX811222.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2100 - RNA, 2061 nt, Artificial Sequence
  KX447516.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2101 - RNA, 2061 nt, Artificial Sequence
  KX520666.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2102 - RNA, 2061 nt, Artificial Sequence
  KU497555.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2103 - RNA, 2061 nt, Artificial Sequence
  KY075939.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2104 - RNA, 2061 nt, Artificial Sequence
  KY075932.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2105 - RNA, 2061 nt, Artificial Sequence
  KU870645.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2106 - RNA, 2061 nt, Artificial Sequence
  KU729217.2 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2107 - RNA, 2061 nt, Artificial Sequence
  KX087101.3 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2108 - RNA, 2061 nt, Artificial Sequence
  KY014317.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2109 - RNA, 2061 nt, Artificial Sequence
  KU758876.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgcc

SEQ ID NO: 2110 - RNA, 2061 nt, Artificial Sequence
  KU758874.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2111 - RNA, 2061 nt, Artificial Sequence
  KY317939.1 prME-short CDS opt
accagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2112 - RNA, 2061 nt, Artificial Sequence
  KY014314.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2113 - RNA, 2061 nt, Artificial Sequence
  KX447517.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgcc

SEQ ID NO: 2114 - RNA, 2061 nt, Artificial Sequence
  KU926310.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2115 - RNA, 2061 nt, Artificial Sequence
  KU922923.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2116 - RNA, 2061 nt, Artificial Sequence
  KY075937.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2117 - RNA, 2061 nt, Artificial Sequence
  KY003156.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2118 - RNA, 2061 nt, Artificial Sequence
  KU312313.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 2119 - RNA, 2061 nt, Artificial Sequence
  KY075935.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2120 - RNA, 2061 nt, Artificial Sequence
  KY014320.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2121 - RNA, 2061 nt, Artificial Sequence
  KY328290.1 prME-short CDS opt
accagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2122 - RNA, 2061 nt, Artificial Sequence
  KU681081.3 prME-short CDS opt
accagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2123 - RNA, 2061 nt, Artificial Sequence
  KX827309.1 prME-short CDS opt
accagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2124 - RNA, 2061 nt, Artificial Sequence
  KU955593.1 prME-short CDS opt
accagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgcc

SEQ ID NO: 2125 - RNA, 2061 nt, Artificial Sequence
  KY272987.1 prME-short CDS opt
accagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgcc

SEQ ID NO: 2126 - RNA, 2061 nt, Artificial Sequence
  KY007221.1 prME-short CDS opt
accagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgcc

SEQ ID NO: 2127 - RNA, 2061 nt, Artificial Sequence
  EU545988.1 prME-short CDS opt
accagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgcc

SEQ ID NO: 2128 - RNA, 2061 nt, Artificial Sequence
  KU681082.3 prME-short CDS opt
accagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgcc

SEQ ID NO: 2129 - RNA, 2061 nt, Artificial Sequence
  KX601167.1 prME-short CDS opt
accagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgcc

SEQ ID NO: 2130 - RNA, 2061 nt, Artificial Sequence
  KX694533.2 prME-short CDS opt
accagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgcc

SEQ ID NO: 2131 - RNA, 2061 nt, Artificial Sequence
  KY288905.1 prME-short CDS opt
accagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2132 - RNA, 2061 nt, Artificial Sequence
  KF268950.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2133 - RNA, 2061 nt, Artificial Sequence
  KF383121.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2134 - RNA, 2043 nt, Artificial Sequence
  KF268949.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2135 - RNA, 2061 nt, Artificial Sequence
  KU955595.1 prME-short CDS opt
accagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2136 - RNA, 2061 nt, Artificial Sequence
  KF383116.1 prME-short CDS opt
accagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2137 - RNA, 2043 nt, Artificial Sequence
  KX601166.1 prME-short CDS opt
accagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2138 - RNA, 2061 nt, Artificial Sequence
  KF383118.1 prME-short CDS opt
accagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2139 - RNA, 2058 nt, Artificial Sequence
  KX447520.1 prME-short CDS opt
agcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2140 - RNA, 2061 nt, Artificial Sequence
  KU761561.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2141 - RNA, 2061 nt, Artificial Sequence
  KX806557.2 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2142 - RNA, 2061 nt, Artificial Sequence
  LC191864.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 2143 - RNA, 2061 nt, Artificial Sequence
  KU744693.1 prME-short CDS opt
accagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggc

SEQ ID NO: 2144 - RNA, 2052 nt, Artificial Sequence
  KU963574.2 prME-short CDS opt
ggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 2145 - RNA, 2070 nt, Artificial Sequence
  KF383120.1 prME-short CDS opt
ggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgcc

SEQ ID NO: 2146 - RNA, 1353 nt, Artificial Sequence; identical to SEQ ID NO: 1921
  KU321639.1 solE CDS opt

SEQ ID NO: 2147 - RNA, 1353 nt, Artificial Sequence; identical to SEQ ID NO: 1922
  KU312312.1 solE CDS opt

SEQ ID NO: 2148 - RNA, 1341 nt, Artificial Sequence; identical to SEQ ID NO: 1923
  AY632535.2 solE CDS opt

SEQ ID NO: 2149 - RNA, 1353 nt, Artificial Sequence; identical to SEQ ID NO: 1922
  KU527068.1 solE CDS opt

SEQ ID NO: 2150 - RNA, 1353 nt, Artificial Sequence
  KX421193.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2151 - RNA, 1353 nt, Artificial Sequence
  LC002520.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2152 - RNA, 1335 nt, Artificial Sequence
  DQ859059.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2153 - RNA, 1341 nt, Artificial Sequence
  KU963573.2 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2154 - RNA, 1353 nt, Artificial Sequence
  KY075939.1 solE CDS opt
agccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2155 - RNA, 1353 nt, Artificial Sequence
  KX447516.1 solE CDS opt
agcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2156 - RNA, 1353 nt, Artificial Sequence
  KX447515.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagc

SEQ ID NO: 2157 - RNA, 1353 nt, Artificial Sequence
  KU758874.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2158 - RNA, 1353 nt, Artificial Sequence
  KU729218.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2159 - RNA, 1353 nt, Artificial Sequence
  KU501217.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2160 - RNA, 1353 nt, Artificial Sequence
  KU761561.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagc

SEQ ID NO: 2161 - RNA, 1353 nt, Artificial Sequence
  KY075937.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2162 - RNA, 1353 nt, Artificial Sequence
  KY014317.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2163 - RNA, 1353 nt, Artificial Sequence
  KU870645.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2164 - RNA, 1353 nt, Artificial Sequence
  KU922923.1 solE CDS opt
agccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2165 - RNA, 1353 nt, Artificial Sequence
  KU497555.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2166 - RNA, 1353 nt, Artificial Sequence
  KU312314.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2167 - RNA, 1353 nt, Artificial Sequence
  KY014314.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2168 - RNA, 1353 nt, Artificial Sequence
  KX447517.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2169 - RNA, 1353 nt, Artificial Sequence
  KU729217.2 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2170 - RNA, 1353 nt, Artificial Sequence
  KY328290.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2171 - RNA, 1353 nt, Artificial Sequence
  KX087101.3 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2172 - RNA, 1353 nt, Artificial Sequence
  KY003156.1 solE CDS opt
agccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2173 - RNA, 1353 nt, Artificial Sequence
  KU758876.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2174 - RNA, 1353 nt, Artificial Sequence
  KU926310.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2175 - RNA, 1353 nt, Artificial Sequence
  KU681081.3 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2176 - RNA, 1353 nt, Artificial Sequence
  KU744693.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2177 - RNA, 1353 nt, Artificial Sequence
  EU545988.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2178 - RNA, 1353 nt, Artificial Sequence
  KY007221.1 solE CDS opt
agccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2179 - RNA, 1353 nt, Artificial Sequence
  KY003152.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcgccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2180 - RNA, 1353 nt, Artificial Sequence
  KX694533.2 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2181 - RNA, 1353 nt, Artificial Sequence
  KX601167.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagc

SEQ ID NO: 2182 - RNA, 1353 nt, Artificial Sequence
  KY288905.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2183 - RNA, 1353 nt, Artificial Sequence
  KF268950.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2184 - RNA, 1353 nt, Artificial Sequence
  KF383116.1 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2185 - RNA, 1335 nt, Artificial Sequence
  KU963574.2 solE CDS opt
agccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagc

SEQ ID NO: 2186 - RNA, 1353 nt, Artificial Sequence
  KF383118.1 solE CDS opt
agccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2187 - RNA, 1353 nt, Artificial Sequence
  KX520666.1 solE CDS opt
agacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagc

SEQ ID NO: 2188 - RNA, 1353 nt, Artificial Sequence
  KF383120.1 solE CDS opt
agccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagc

SEQ ID NO: 2189 - RNA, 2136 nt, Artificial Sequence
  ZIKV (strain ZikaSPH2015) Polyprotein(93-804) CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaa

SEQ ID NO: 2190 - RNA, 2136 nt, Artificial Sequence
  ZIKV (isolate Z1106033) Polyprotein(93-804) CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaaugccaagaacgggagcaucucccugaugugucuugcucugggaggcguucucauuuuccugagcaccgccgugucugccgacgucgggugcuccguggauuuuagcaaa

SEQ ID NO: 2191 - RNA, 2124 nt, Artificial Sequence
  ZIKV (strain MR 766) Polyprotein(93-800) CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugaggacagagcuaagguggaggucacaccuaauagcccgcgcgcggaagccacccuuggcggcuucgggucccugggacucgauugugagccccggaccggccuggacuuuucugaucuuuauuaccugacaaugaacaauaaacacuggcucgugcauaaggaaugguuccacgacauuccucugcccuggcacgcuggggccgauaccggaacaccucauuggaacaauaaagaggcccuggucgaauuuaaggacgcucacgccaagagacagacggugguugugcucggcagccaggagggggcgguccauaccgcucuggccggcgcccuugaggcugaaauggauggagccaaaggccgccuguucuccgggcaccucaagugccggcugaaaauggacaaacuuagacugaagggagugagcuauucucucuguacagcugccuuuaccuucacaaagguucccgcggagacccugcauggcacggugaccgucgaagugcaguacgccgggacagacggaccgugcaagaucccugugcaaauggcuguugauaugcagacccugacacccgucggccgccucaucaccgccaacccugugauuacggaguccacagaaaauagcaaaaugaugcuggagcuugacccucccuuuggggauucuuacaucgugauuggcgucggagacaagaaaaucacccaccacuggcaucgguccggcagcacaauugggaaggcuuucgaggccaccgugagaggagcgaaacgcauggccguucugggcgauaccgcuugggacuucggguccgugggaggcgucuuuaacucucucgggaagggcauccaccagaucuucggagccgcuuuuaagagccuguucggcgggauguccugguuuucucaaauucugaucggaacacuucucguguggcugggccugaacacgaaaaaugggagcauuucccucaccugucuggcccuuggaggcguuaugaucuuccugagcacagccgugucugcugaugucgggugcuccguggacuuuagcaag

SEQ ID NO: 2192 - RNA, 2136 nt, Artificial Sequence
  ZIKV (strain NatalRGN) Polyprotein(93-804) CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaa

SEQ ID NO: 2193 - RNA, 2061 nt, Artificial Sequence
  ZIKV (strain ZikaSPH2015) Polyprotein(108-794) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugcc

SEQ ID NO: 2194 - RNA, 2061 nt, Artificial Sequence
  ZIKV (isolate Z1106033) Polyprotein(108-794) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacgcuaagaauggcagcaucucccugaugugucuugcgcuugggggagugcucauuuuccugagcaccgccgugucugcu

SEQ ID NO: 2195 - RNA, 2049 nt, Artificial Sequence
  ZIKV (strain MR 766) Polyprotein(108-790) CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacaauuggcaaggcuuucgaggccaccgugcgcggggcuaaacggauggccguucugggagacaccgcgugggauuucggcuccgucgggggaguguuuaauucucucggcaaggggauccaccagauuuucggcgccgcuuuuaaaagccuguucggaggcauguccugguuuucucaaauccugaucgggacacuucucguguggcugggacugaacacgaagaacggcagcauuucccucaccugucuggcccuugggggaguuaugaucuuccugagcacagcugugucugcc

SEQ ID NO: 2196 - RNA, 2061 nt, Artificial Sequence
  ZIKV (strain NatalRGN) Polyprotein(108-794) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugcc

SEQ ID NO: 2197 - RNA, 1353 nt, Artificial Sequence
  ZIKV (strain ZikaSPH2015) Polyprotein(273-723) CDS opt
agccagaaggugaucuaccuggucaugauucuccugaucgcccccgcuuauuccauuagaugcaucggcguuucuaaccgggacuucguggaggggaugagcggaggcaccuggguggauauuguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagc

SEQ ID NO: 2198 - RNA, 1353 nt, Artificial Sequence
  ZIKV (isolate Z1106033) Polyprotein(273-723) CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgaaacgcauggcuguucucggggacacggccugggauuuuggaagc

SEQ ID NO: 2199 - RNA, 1341 nt, Artificial Sequence
  ZIKV (strain MR 766) Polyprotein(273-719) CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugaggaccgggccaagguugaagugaccccuaacagcccccgcgcugaggccacacucgggggauuuggcucucugggccuggauugcgagccuagaaccgggcuugacuucuccgaucuguacuaccucacgaugaauaacaaacauuggcuggugcacaaggaaugguuucaugacauuccccuuccuuggcacgcgggagccgacacaggcaccccgcacuggaauaacaaagaggcucuggucgaguucaaggaugcccaugcuaagcggcagacagugguugugcucgggagccaggaaggagccguccacaccgcgcuggccggcgcucuggaagccgagauggacggggcuaaaggacgccucuuuuccggccaucugaaguguagacuuaaaauggauaagcugcggcucaaaggcgugucuuauagccugugcaccgccgccuucacauuuacgaagguucccgcugagacccuucacgggacagugaccgucgaagugcaauacgcgggaacagacggcccuuguaaaauccccguccagauggccguggauaugcagacccugacgccuguugggcgccucauuacagcuaaucccgugaucaccgaguccaccgaaaacagcaagaugaugcuggagcuggacccgccuuucggagauucuuauauugucaucggcgugggggacaagaaaaucacacaccauuggcacagauccggcagcaccauuggaaaggccuuugaagccacaguucggggcgcuaaacgcauggccgugcucggggauacggcgugggacuucggaucu

SEQ ID NO: 2200 - RNA, 1353 nt, Artificial Sequence; identical to SEQ ID NO: 2198
  ZIKV (strain NatalRGN) Polyprotein(273-723) CDS opt

SEQ ID NO: 2201 - RNA, 2061 nt, Artificial Sequence
  ZIKV (strain ZikaSPH2015) Polyprotein(108-794)(F398S) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagccucuauuuccgacauggcuagcgauuccagaugucccacgcaaggggaggcuuaccuggacaagcagucugacacccaguaugugugcaaacggacacucguugaucgcggauggggcaauggcugugggcugagcggaaagggcucccuggugaccugcgccaaauucgccugcagcaagaaaaugacagggaagucuauccagccugaaaaccucgaguacagaaucaugcuguccguccacggaagccaacacucuggcaugauugugaaugacaccgggcaugaaacggaugagaaccgggcuaagguugagaucacaccgaauagccccagagcggaagccacccuuggaggcuuuggcucccuggggcucgacugugagccucgcaccggacuggauuucucugaccuuuauuaccugacaaugaacaauaaacacuggcucgugcauaaggaaugguuucacgauauuccccugccuuggcacgcuggcgccgacaccgggacaccccauuggaacaauaaagaggcccuggucgaguucaaggaugcucacgccaaacggcagacgguggucgugcucggaagccaggaaggcgcgguucauaccgcucuggccggggcccuugaggcugaaauggacggcgccaagggaagacuguccagcggccaccucaaaugccgccugaagauggauaagcugcggcugaaaggggugucuuauucccucuguacagcugccuuuaccuucacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggagagcacagaaaacucuaagaugaugcuggagcuugaucccccuuuuggcgacuccuacaucguuauuggggucggcgagaaaaagaucacccaccacuggcaucgcagcggauccacaauuggcaaggccuucgaagcgaccgugagaggggccaaacggauggcugugcugggagauaccgccugggacuuuggcucugucgggggagcucucaauagccugggcaaggggauccaccagauuuucggcgccgccuucaaaucccuguuuggaggcaugucuugguucagccaaauccuuaucgggacacuccugauguggcugggacucaacacgaagaauggcuccauuagccugaugugucuugcucuugggggagugcucaucuuucugucuaccgcgguuuccgcc

SEQ ID NO: 2202 - RNA, 2061 nt, Artificial Sequence
  ZIKV (isolate Z1106033) Polyprotein(108-794)(F398S) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagccucuaucuccgacauggcuagcgauuccagaugucccacccaaggggaggcuuaccuggacaagcagucugacacacaguauguuugcaaacggacccucguggaucgcggauggggcaauggcugugggcugagcggaaagggcucccuggucacaugcgccaaauucgccugcagcaagaaaaugaccgggaagucuauucagccugaaaaccucgaguacagaaucaugcuguccgugcacggaagccaacacucuggcaugaucguuaaugacacggggcaugaaacagaugagaaccgggcuaagguggagauuaccccgaauagccccagagcggaagccacccuuggaggcuuuggcucccuggggcucgacugugagccucgcacaggacuggauuucucugaccuuuauuaccugaccaugaacaauaaacacuggcucguccauaaggaaugguuucacgauaucccccugccuuggcacgcuggcgccgacacagggacgccccauuggaacaauaaagaggcccugguggaguucaaggaugcucacgccaaacggcagaccgucgugguucucggaagccaggaaggcgcggugcauacagcucuggccggggcccuugaggcugaaauggacggcgccaagggaagacuguccagcggccaccucaaaugccgccugaagauggauaagcugcggcugaaaggggucucuuauucccucuguaccgcugccuuuacauucaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagagcaccgaaaacucuaagaugaugcuggagcuugaucccccuuuuggcgacuccuacaucgucaucggggugggcgagaaaaagauuacacaccacuggcaucgcagcggauccaccaucggcaaggccuucgaagcgaccgugagaggggccaaacggauggcuguccugggagauacagccugggacuuuggcucuguugggggagcucucaauagccugggcaaggggauucaccagaucuucggcgccgccuucaaaucccuguuuggaggcaugucuugguucagccaaauucuuaucgggacgcuccugauguggcugggacucaacgcuaagaauggcuccaucagccugaugugucuugcgcuugggggagugcucauuuuucugucuaccgccguguccgcu

SEQ ID NO: 2203 - RNA, 2049 nt, Artificial Sequence
  ZIKV (strain MR 766) Polyprotein(108-790)(F398S) CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguccggaaagggcagccuggugaccugcgcuaaauucacaugcucuaagaagaugaccgggaaauccauccagcccgagaaucucgaauaucgcauuaugcugagcguucacggaucucaacauagcggcaugaucggguacgagacggacgaagauagagccaagguggaggucacaccuaacuccccgcgggccgaggcuacccuuggaggcuuuggcucucuggggcucgacugugaacccagaaccggacuggauuucagcgaccuuuauuaccugacaaugaauaacaaacacuggcucgugcauaaggagugguuucacgauauuccucugcccuggcacgcgggcgccgacaccgggacaccucauuggaauaacaaagaagcucuggucgaguucaaggaugcccacgccaaacgccagacggugguugugcucggaucccaggaaggcgcuguccauaccgcccuggcgggggcucuugaggccgagauggacggcgccaagggacggcuguuuagcggccaccucaagugcagacugaaaauggauaaacuucgccugaagggggugucuuauucccucuguacagcugccuucaccuuuacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaaagcacagagaacucuaagaugaugcuggaacuugauccucccuucggcgacuccuacaucgugauuggggucggcgauaagaaaaucacccaccacuggcauagaagcggauccacaauuggcaaggcuuuugaggccaccgugcgcggggcuaaacggauggccguucugggagacaccgcgugggauuucggcucugucgggggaguguucaauagccucggcaaggggauccaccagauuuuuggcgccgcuuucaaaucccuguuuggaggcaugucuugguucagccaaauccugaucgggacacuucucguguggcugggacugaacacgaagaacggcuccauuagccucaccugucuggcccuugggggaguuaugaucuuucugucuacagcuguguccgcc

SEQ ID NO: 2204 - RNA, 2061 nt, Artificial Sequence
  ZIKV (strain NatalRGN) Polyprotein(108-794)(F398S) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcugagcggaaagggcucccuggugaccugcgccaaauucgccugcagcaagaaaaugacagggaagucuauucagccugaaaaccucgaguacagaaucaugcuguccgugcacggaagccaacacucuggcaugaucguuaaugacaccgggcaugaaacggaugagaaccgggcuaagguggagauuacaccgaauagccccagagcggaagccacccuuggaggcuuuggcucccuggggcucgacugugagccucgcaccggacuggauuucucugaccuuuauuaccugacaaugaacaauaaacacuggcucguccauaaggaaugguuucacgauaucccccugccuuggcacgcuggcgccgacaccgggacaccccauuggaacaauaaagaggcccugguggaguucaaggaugcucacgccaaacggcagacggucgugguucucggaagccaggaaggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuuuaccuucacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggagagcacagaaaacucuaagaugaugcuggagcuugaucccccuuuuggcgacuccuacaucgucaucggggugggcgagaaaaagauuacccaccacuggcaucgcagcggauccacaaucggcaaggccuucgaagcgaccgugagaggggccaaacggauggcuguccugggagauaccgccugggacuuuggcucugucgggggagcucucaauagccugggcaaggggauucaccagaucuucggcgccgccuucaaaucccuguuuggaggcaugucuugguucagccaaauucuuaucgggacacuccugauguggcugggacucaacacgaagaauggcuccaucagccugaugugucuugcucuugggggaguucucauuuuucugucuaccgcgguguccgcc

SEQ ID NO: 2205 - RNA, 2061 nt, Artificial Sequence
  ZIKV (strain ZikaSPH2015) Polyprotein(108-794)(N444Q) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugcaggacaccgggcaugaaacggaugagaaucgggcuaagguugagaucacaccgaacucucccagagcggaagccacccuuggaggcuucggcagccuggggcucgacugugagccucgcaccggacuggauuuuuccgaccuuuauuaccugacaaugaauaacaaacacuggcucgugcauaaggaaugguuccacgauauuccccugccuuggcacgcuggcgccgacaccgggacaccccauuggaauaacaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaauacgccggcacagacgggccuugcaaagugcccgcucagauggccgucgacaugcagacccugacaccugugggaagacucauuaccgcuaaucccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaacucucugggcaaggggauccaccaaauuuucggcgccgccuuuaaaagccuguucggaggcauguccugguuuucucagauccuuaucgggacacuccugauguggcugggacucaauacgaagaacggcagcauuucccugaugugucuugcucuugggggagugcucaucuuccugagcaccgcgguuucugcc

SEQ ID NO: 2206 - RNA, 2061 nt, Artificial Sequence
  ZIKV (isolate Z1106033) Polyprotein(108-794)(N444Q) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguucaggacacggggcaugaaacagaugagaaucgggcuaagguggagauuaccccgaacucucccagagcggaagccacccuuggaggcuucggcagccuggggcucgacugugagccucgcacaggacuggauuuuuccgaccuuuauuaccugaccaugaauaacaaacacuggcucguccauaaggaaugguuccacgauaucccccugccuuggcacgcuggcgccgacacagggacgccccauuggaauaacaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaauacgccggcaccgacgggccuugcaaaguccccgcucagauggccguggacaugcagacacugaccccugugggaagacucaucacggcuaaucccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaacucucugggcaaggggauucaccaaaucuucggcgccgccuuuaaaagccuguucggaggcauguccugguuuucucagauucuuaucgggacgcuccugauguggcugggacucaaugcuaagaacggcagcaucucccugaugugucuugcgcuugggggagugcucauuuuccugagcaccgccgugucugcu

SEQ ID NO: 2207 - RNA, 2061 nt, Artificial Sequence
  ZIKV (strain NatalRGN) Polyprotein(108-794)(N444Q) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguucaggacaccgggcaugaaacggaugagaaucgggcuaagguggagauuacaccgaacucucccagagcggaagccacccuuggaggcuucggcagccuggggcucgacugugagccucgcaccggacuggauuuuuccgaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggaagacucaucaccgcuaaucccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaacucucugggcaaggggauucaccaaaucuucggcgccgccuuuaaaagccuguucggaggcauguccugguuuucucagauucuuaucgggacacuccugauguggcugggacucaauacgaagaacggcagcaucucccugaugugucuugcucuugggggaguucucauuuuccugagcaccgcggugucugcc

SEQ ID NO: 2208 - RNA, 2061 nt, Artificial Sequence
  ZIKV (strain ZikaSPH2015) Polyprotein(108-694)-Cterm-JAEV1-E(400-500) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaaacuucggcugaagggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacacugggcaaggccuuuuccaccacccucaaaggggcgcagcggcuggccgcucugggagauacagccugggacuucggcucuauugggggaguguucaauagcaucggcagagcugugcaccaagucuuugggggcgccuuccgcacgcuuuuuggaggcauguccuggauuacccaggggcucaugggagcccugcugcucuggaugggcgugaacgcucgggauagaucuaucgcgcuggccuuccuugcuacagggggaguucugguguuucucgccaccaauguccaugcc

SEQ ID NO: 2209 - RNA, 2061 nt, Artificial Sequence
  ZIKV (isolate Z1106033) Polyprotein(108-694)-Cterm-JAEV1-E(400-500) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaaacuucggcugaagggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcacccugggcaaggccuuuuccaccacacucaaaggggcgcagcggcuggccgcucugggagauacggccugggacuucggcucuaucgggggaguguucaauagcauuggcagagcuguccaccaaguguuugggggcgccuuccgcacccuuuuuggaggcauguccuggaucacacaggggcucaugggagcccugcugcucuggaugggcguuaacgcucgggauagaucuauugcgcuggccuuccuugcuaccgggggagugcuggucuuucucgccacaaaugugcaugcc

SEQ ID NO: 2210 - RNA, 2049 nt, Artificial Sequence
  ZIKV (strain MR 766) Polyprotein(108-690)-Cterm-JAEV1-E(400-500) CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacacugggcaaggcuuucuccaccacccucaaaggggcccagcgccuggcugcccugggagacacagcgugggauuucggcucuauugggggaguguuuaauagcaucggccgggccguucaccaaguguucgggggcgcuuuuagaacgcuuuucggaggcauguccuggauuacccaggggcucaugggagcccugcugcucuggaugggcgucaacgcucgcgaccggucuaucgcccuggccuuucuugcuacagggggagugcugguuuuccucgcgaccaacgugcaugcc

SEQ ID NO: 2211 - RNA, 2061 nt, Artificial Sequence
  ZIKV (strain NatalRGN) Polyprotein(108-694)-Cterm-JAEV1-E(400-500) CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaaacuucggcugaagggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacacugggcaaggccuuuuccaccacccucaaaggggcgcagcggcuggccgcucugggagauacagccugggacuucggcucuaucgggggaguguucaauagcauuggcagagcuguccaccaaguguuugggggcgccuuccgcacgcuuuuuggaggcauguccuggaucacccaggggcucaugggagcccugcugcucuggaugggcguuaacgcucgggauagaucuauugcgcuggccuuccuugcuacagggggagugcuggucuuucucgccaccaaugugcaugcc

SEQ ID NO: 2212 - RNA, 2136 nt, Artificial Sequence; identical to SEQ ID NO: 2189
  ZIKV (strain ZikaSPH2015) Polyprotein(93-804) CDS opt

SEQ ID NO: 2213 - RNA, 2133 nt, Artificial Sequence
  ZIKV prME variant CDS opt
aucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaa

SEQ ID NO: 2214 - RNA, 2130 nt, Artificial Sequence
  ZIKV prME variant CDS opt
aucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcuccgucgauuuuagcaaa

SEQ ID NO: 2215 - RNA, 2127 nt, Artificial Sequence
  ZIKV prME variant CDS opt
aacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaa

SEQ ID NO: 2216 - RNA, 2124 nt, Artificial Sequence
  ZIKV prME variant CDS opt
gccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaa

SEQ ID NO: 2217 - RNA, 2121 nt, Artificial Sequence
  ZIKV prME variant CDS opt
agaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaa

SEQ ID NO: 2218 - RNA, 2118 nt, Artificial Sequence
  ZIKV prME variant CDS opt
aaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaa

SEQ ID NO: 2219 - RNA, 2115 nt, Artificial Sequence
  ZIKV prME variant CDS opt
gagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaag

SEQ ID NO: 2220 - RNA, 2112 nt, Artificial Sequence
  ZIKV prME variant CDS opt
aagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaag

SEQ ID NO: 2221 - RNA, 2109 nt, Artificial Sequence
  ZIKV prME variant CDS opt
aagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcuccgucgauuuuagcaag

SEQ ID NO: 2222 - RNA, 2106 nt, Artificial Sequence
  ZIKV prME variant CDS opt
agacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaa

SEQ ID NO: 2223 - RNA, 2103 nt, Artificial Sequence
  ZIKV prME variant CDS opt
agaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaa

SEQ ID NO: 2224 - RNA, 2100 nt, Artificial Sequence
  ZIKV prME variant CDS opt
ggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaa

SEQ ID NO: 2225 - RNA, 2097 nt, Artificial Sequence
  ZIKV prME variant CDS opt
gccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcuccgucgauuuuagcaaa

SEQ ID NO: 2226 - RNA, 2094 nt, Artificial Sequence
  ZIKV prME variant CDS opt
gacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcuccgucgauuuuagcaaa

SEQ ID NO: 2227 - RNA, 2091 nt, Artificial Sequence
  ZIKV prME variant CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcuccgucgacuuuagcaaa

SEQ ID NO: 2228 - RNA, 2091 nt, Artificial Sequence
  ZIKV prME variant CDS opt
accagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcuccgucgacuuuagcaaa

SEQ ID NO: 2229 - RNA, 2103 nt, Artificial Sequence
  ZIKV prME variant CDS opt
agaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaa

SEQ ID NO: 2230 - RNA, 2127 nt, Artificial Sequence
  ZIKV prME variant CDS opt
agaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcucugucgauuucuccaag

SEQ ID NO: 2231 - RNA, 2127 nt, Artificial Sequence
  ZIKV prME variant CDS opt
agaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcucugucgauuucuccaag

SEQ ID NO: 2232 - RNA, 2118 nt, Artificial Sequence
  ZIKV prME variant CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugc

SEQ ID NO: 2233 - RNA, 2115 nt, Artificial Sequence
  ZIKV prME variant CDS opt
aucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugc

SEQ ID NO: 2234 - RNA, 2112 nt, Artificial Sequence
  ZIKV prME variant CDS opt
aucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugc

SEQ ID NO: 2235 - RNA, 2109 nt, Artificial Sequence
  ZIKV prME variant CDS opt
aacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugc

SEQ ID NO: 2236 - RNA, 2106 nt, Artificial Sequence
  ZIKV prME variant CDS opt
gccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugc

SEQ ID NO: 2237 - RNA, 2103 nt, Artificial Sequence
  ZIKV prME variant CDS opt
agaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2238 - RNA, 2100 nt, Artificial Sequence
  ZIKV prME variant CDS opt
aaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2239 - RNA, 2097 nt, Artificial Sequence
  ZIKV prME variant CDS opt
gagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2240 - RNA, 2094 nt, Artificial Sequence
  ZIKV prME variant CDS opt
aagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2241 - RNA, 2091 nt, Artificial Sequence
  ZIKV prME variant CDS opt
aagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugc

SEQ ID NO: 2242 - RNA, 2088 nt, Artificial Sequence
  ZIKV prME variant CDS opt
agacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2243 - RNA, 2085 nt, Artificial Sequence
  ZIKV prME variant CDS opt
agaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2244 - RNA, 2082 nt, Artificial Sequence
  ZIKV prME variant CDS opt
ggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugc

SEQ ID NO: 2245 - RNA, 2079 nt, Artificial Sequence
  ZIKV prME variant CDS opt
gccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugc

SEQ ID NO: 2246 - RNA, 2076 nt, Artificial Sequence
  ZIKV prME variant CDS opt
gacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugc

SEQ ID NO: 2247 - RNA, 2073 nt, Artificial Sequence
  ZIKV prME variant CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugc

SEQ ID NO: 2248 - RNA, 2073 nt, Artificial Sequence
  ZIKV prME variant CDS opt
accagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugc

SEQ ID NO: 2249 - RNA, 2085 nt, Artificial Sequence
  ZIKV prME variant CDS opt
agaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugc

SEQ ID NO: 2250 - RNA, 2109 nt, Artificial Sequence
  ZIKV prME variant CDS opt
agaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugc

SEQ ID NO: 2251 - RNA, 2109 nt, Artificial Sequence
  ZIKV prME variant CDS opt
agaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugc

SEQ ID NO: 2252 - RNA, 2109 nt, Artificial Sequence
  ZIKV prME variant CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgac

SEQ ID NO: 2253 - RNA, 2106 nt, Artificial Sequence
  ZIKV prME variant CDS opt
aucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgac

SEQ ID NO: 2254 - RNA, 2103 nt, Artificial Sequence
  ZIKV prME variant CDS opt
aucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgac

SEQ ID NO: 2255 - RNA, 2100 nt, Artificial Sequence
  ZIKV prME variant CDS opt
aacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgac

SEQ ID NO: 2256 - RNA, 2097 nt, Artificial Sequence
  ZIKV prME variant CDS opt
gccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgac

SEQ ID NO: 2257 - RNA, 2094 nt, Artificial Sequence
  ZIKV prME variant CDS opt
agaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2258 - RNA, 2091 nt, Artificial Sequence
  ZIKV prME variant CDS opt
aaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2259 - RNA, 2088 nt, Artificial Sequence
  ZIKV prME variant CDS opt
gagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2260 - RNA, 2085 nt, Artificial Sequence
  ZIKV prME variant CDS opt
aagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2261 - RNA, 2082 nt, Artificial Sequence
  ZIKV prME variant CDS opt
aagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugac

SEQ ID NO: 2262 - RNA, 2079 nt, Artificial Sequence
  ZIKV prME variant CDS opt
agacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2263 - RNA, 2076 nt, Artificial Sequence
  ZIKV prME variant CDS opt
agaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2264 - RNA, 2073 nt, Artificial Sequence
  ZIKV prME variant CDS opt
ggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugac

SEQ ID NO: 2265 - RNA, 2070 nt, Artificial Sequence
  ZIKV prME variant CDS opt
gccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugac

SEQ ID NO: 2266 - RNA, 2067 nt, Artificial Sequence
  ZIKV prME variant CDS opt
gacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgac

SEQ ID NO: 2267 - RNA, 2064 nt, Artificial Sequence
  ZIKV prME variant CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgau

SEQ ID NO: 2268 - RNA, 2064 nt, Artificial Sequence
  ZIKV prME variant CDS opt
accagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugau

SEQ ID NO: 2269 - RNA, 2076 nt, Artificial Sequence
  ZIKV prME variant CDS opt
agaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgac

SEQ ID NO: 2270 - RNA, 2100 nt, Artificial Sequence
  ZIKV prME variant CDS opt
agaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgac

SEQ ID NO: 2271 - RNA, 2100 nt, Artificial Sequence
  ZIKV prME variant CDS opt
agaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugac

SEQ ID NO: 2272 - RNA, 2106 nt, Artificial Sequence
  ZIKV prME variant CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugcc

SEQ ID NO: 2273 - RNA, 2100 nt, Artificial Sequence
  ZIKV prME variant CDS opt
aucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugcc

SEQ ID NO: 2274 - RNA, 2103 nt, Artificial Sequence
  ZIKV prME variant CDS opt
aucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugcc

SEQ ID NO: 2275 - RNA, 2097 nt, Artificial Sequence
  ZIKV prME variant CDS opt
aacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugcc

SEQ ID NO: 2276 - RNA, 2094 nt, Artificial Sequence
  ZIKV prME variant CDS opt
gccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugcc

SEQ ID NO: 2277 - RNA, 2091 nt, Artificial Sequence
  ZIKV prME variant CDS opt
agaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2278 - RNA, 2088 nt, Artificial Sequence
  ZIKV prME variant CDS opt
aaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2279 - RNA, 2085 nt, Artificial Sequence
  ZIKV prME variant CDS opt
gagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2280 - RNA, 2082 nt, Artificial Sequence
  ZIKV prME variant CDS opt
aagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2281 - RNA, 2079 nt, Artificial Sequence
  ZIKV prME variant CDS opt
aagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcu

SEQ ID NO: 2282 - RNA, 2076 nt, Artificial Sequence
  ZIKV prME variant CDS opt
agacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2283 - RNA, 2073 nt, Artificial Sequence
  ZIKV prME variant CDS opt
agaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2284 - RNA, 2070 nt, Artificial Sequence
  ZIKV prME variant CDS opt
ggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcu

SEQ ID NO: 2285 - RNA, 2067 nt, Artificial Sequence
  ZIKV prME variant CDS opt
gccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcu

SEQ ID NO: 2286 - RNA, 2064 nt, Artificial Sequence
  ZIKV prME variant CDS opt
gacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugcc

SEQ ID NO: 2287 - RNA, 2061 nt, Artificial Sequence; identical to SEQ ID NO: 2193
  ZIKV (strain ZikaSPH2015) Polyprotein(108-794) CDS opt

SEQ ID NO: 2288 - RNA, 2061 nt, Artificial Sequence
  ZIKV prME variant CDS opt
accagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcu

SEQ ID NO: 2289 - RNA, 2073 nt, Artificial Sequence
  ZIKV prME variant CDS opt
agaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugcc

SEQ ID NO: 2290 - RNA, 2097 nt, Artificial Sequence
  ZIKV prME variant CDS opt
agaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgcc

SEQ ID NO: 2291 - RNA, 2097 nt, Artificial Sequence
  ZIKV prME variant CDS opt
agaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcu

SEQ ID NO: 2292 - RNA, 2136 nt, Artificial Sequence; identical to SEQ ID NO: 2189
  KU321639.1 prME-long CDS opt

SEQ ID NO: 2293 - RNA, 2136 nt, Artificial Sequence; identical to SEQ ID NO: 2190
  KU312312.1 prME-long CDS opt

SEQ ID NO: 2294 - RNA, 2124 nt, Artificial Sequence; identical to SEQ ID NO: 2191
  AY632535.2 prME-long CDS opt

SEQ ID NO: 2295 - RNA, 2136 nt, Artificial Sequence; identical to SEQ ID NO: 2192
  KU527068.1 prME-long CDS opt

SEQ ID NO: 2296 - RNA, 2136 nt, Artificial Sequence
  KU720415.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauacgggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaa

SEQ ID NO: 2297 - RNA, 2118 nt, Artificial Sequence
  DQ859059.1 prME-long CDS opt
agaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugaugaaaacagagccaagguggaggucacaccuaauagcccgcgcgcugaggcgacccuuggaggcuucggcucccuggggcucgacugugaaccccggaccggacuggauuuuucugaccuuuacuaucugacaaugaacaauaaacacuggcucgugcauaaggagugguuccacgauaucccucugcccuggcacgccggcgcugacaccgggacaccucauuggaacaauaaagaagcccugguugaguuuaaggaugcccacgcuaagagacagacgguggucgugcucggaagccaggaaggcgccguucauaccgcgcuggcuggggcccuugaggccgagauggacggcgcuaaaggacgccuguucuccggccaccucaagugccggcugaaaauggauaaacuuagacugaagggggugagcuacucucucuguacagccgcuuuuaccuucacaaagguccccgccgaaacccugcauggaacggugaccguggagguucaguaugcgggcacagacgggccgugcaaggucccugcccaaauggcuguggacaugcagacccugacacccgugggacgccucauuaccgccaacccugucaucacggaauccacagagaacagcaaaaugaugcuggaacuugauccucccuuuggcgacucuuacaucgugauugggguuggcgauaagaaaaucacccaccacuggcaucgguccggaagcacaauuggcaaggcuuucgaggccaccgugagaggggcgaaacgcauggccguccugggagacaccgcuugggauuucggcuccguugggggaguguuuaauucucucggcaaggggauccaccagauuuucggcgccgcuuuuaagagccuguucggaggcauguccugguuuucucaaauccugaucgggacacuucucguguggcugggacugaacacgaaaaauggcagcauuucccucaccugucuggcccuugggggagucaugaucuuccugagcacagccgugucugcugacguuggcugcuccguggauuuuagcaag

SEQ ID NO: 2298 - RNA, 2136 nt, Artificial Sequence
  KX377335.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccgcaagaaaggcgaagccagacggagccgcagagcggugacccuuccgucccauucuacacggaagcugcaaacccgcagccagacauggcucgaguccagagaguauaccaagcaccugauuaaaguugaaaauuggaucuuucggaaccccggcuucgcccugguggcugucgccauugcuuggcuccuggggagcucuacgucccagaaggugaucuaccuuguuaugauucugcucaucgccccugcguauagcauucgcugcaucggagugucuaauagagauuuugucgagggcauguccgggggaacauggguggacgugguccuggaacauggcggguguguuaccgugauggcccaggauaaacccacaguggacaucgagcuugucaccaccacagugagcaacauggcugagguucggucuuacugcuacgaagccuccauuagcgauauggcuuccgacucuagauguccuacgcaaggagaggccuaucuggacaagcagagcgauacccaguacgugugcaaacgcacacucgucgaccggggcuggggcaauggguguggacuguucggcaaggggucccuggugaccugcgccaaguuuacaugcagcaaaaagaugaccggaaaaucuauccagcccgaaaaccucgaguauagaauuaugcuguccguucacggcagccaacacucugggaugaucgugaaugauacgggauacgaaacagacgagaaccgcgcuaaggucgaggugaccccuaauagcccgcgggcggaagccacccuuggcggcuucgggucccugggacucgauugugagcccagaacaggccuggacuuuucugaucuuuauuaccugaccaugaacaauaaacauuggcucguccacaaggaaugguuccaugacauuccucugcccuggcacgcuggggccgauacaggaacgccucacuggaacaauaaagaggcccugguggaauuuaaggacgcucaugccaagcgccagaccguugugguccucggcagccaggagggggcggugcacacagcucuggccggcgcccuugaggcugaaauggauggagccaaaggcaagcuguucuccgggcaucucaaaugccggcugaagauggacaaacuuagacugaagggaguuagcuauucucucuguaccgcugccuuuacauucaccaaggugcccgcggagacgcugcacggcaccgucacaguggaagugcaguacgccgggaccgacggaccgugcaaaaucccuguucaaauggcugucgauaugcagacacugacccccgugggccgccucaucacggccaacccugugauuacagaguccaccgaaaacagcaagaugaugcuggagcuugacccucccuuuggggauucuuacaucgucauuggcgugggagacaaaaagaucacacaucacuggcaccgguccggcagcaccauugggaaggcuuucgaggccaccguuagaggagcgaaacgcauggccgugcugggcgauacagcuugggacuucggguccgucggaggcguguuuaauucucucgggaagggcauccaucagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaa

SEQ ID NO: 2299 - RNA, 2136 nt, Artificial Sequence
  LC002520.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugacggugaaugauaucggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaa

SEQ ID NO: 2300 - RNA, 2124 nt, Artificial Sequence
  KU963573.2 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugagaauagagcuaagguggaggucacaccuaacagcccgcgcgcggaagccacccuuggcggcuucgggucccugggacucgacugugagccccggaccggccuggauuuuucugaccuuuauuaccugacaaugaauaacaaacacuggcucgugcauaaggaaugguuccacgauauuccucugcccuggcacgcuggggccgacaccggaacaccucauuggaauaacaaagaggcccuggucgaauuuaaggaugcucacgccaagagacagacggugguugugcucggcagccaggagggggcgguccauaccgcucuggccggcgcccuugaggcugaaauggacggagccaaaggcaagcuguucuccgggcaccucaaaugccgccugaagauggauaaacuucggcugaagggagugagcuauucucucuguacagcugccuuuaccuucacaaagguucccgcggagacccugcauggcacggugaccgucgaagugcaguacgccgggacagacggaccgugcaaaaucccugugcaaauggcuguugacaugcagacccugacacccgucggcagacucaucaccgccaauccugugauuacggaguccacagaaaacagcaagaugaugcuggagcuugauccucccuuuggggacucuuacaucgugauuggcgucggagauaaaaagaucacccaccacuggcaucgcuccggcagcacaauugggaaggcuuucgaggccaccgugcggggagcgaaaagaauggccguucugggcgacaccgcuugggauuucggguccgugggaggcgucuuuaacucucucgggaagggcauccaccagaucuucggagccgcuuuuaaaagccuguucggcgggauguccugguuuucucaaauucugaucggaacacuucucguguggcugggccugaauacgaagaacgggagcauuucccucaccugucuggcccuuggaggcguuaugaucuuccugagcacagccgugucugcugacgucgggugcuccguggauuuuagcaaa

SEQ ID NO: 2301 - RNA, 2136 nt, Artificial Sequence
  KX694534.2 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggcggggcauucaccagaucuucggagcugcguuuaaaagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaag

SEQ ID NO: 2302 - RNA, 2136 nt, Artificial Sequence
  KX447520.1 prME-long CDS opt
agaaucauuaacgcccggaaggagaaaaagcgcagaggcgcugacgccagcguggggaucgucggacugcuccugaccacagcgauggcugccgaaguuacgcggcgcggcuccgccuacuauauguaccuugauagaaaugacgcuggggaggccauuucuuuccccaccacacugggaaugaacaaaugcuauauccagauuauggaucucggccacaugugugacgcuaccaugagcuacgaaugcccuaugcuggaugaggggguggaaccggacgauguggacuguuggugcaauacaaccuccacaugggucguguauggaaccugucaucacaagaaaggcgaggcccggcgcucuagacgggcgguuacgcuucccagccauuccacccgcaagcugcaaacaagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaa

SEQ ID NO: 2303 - RNA, 2136 nt, Artificial Sequence
  KX369547.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggccuggcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcgugggagagaaaaagauuacccaccacuggcaucgguccggcagcacaaucgggaaagccuucgaagcuaccgugagaggagccaagcgcauggcuguccucggcgacaccgccugggauuuuggguccgugggaggcgcccugaacucucuggggaaaggcauucaccagaucuucggagcugcguucaagagccuuuuuggcgggauguccugguucucucaaauccucauuggaacacugcugauguggcucggccugaauacgaagaacgggagcaucucccuuaugugucuggcccucggaggcguucugauuuuucugagcaccgcugugucugccgacgucgggugcuccguggauuucagcaaa

SEQ ID NO: 2304 - RNA, 2136 nt, Artificial Sequence
  KX447515.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacugguaucgguccggcagcacaaucgggaaagccuuugaagcuaccgugagaggagccaagcgcauggcuguccugggcgacaccgccugggauuucggguccgugggaggcgcccucaacucucuggggaaaggcauucaucagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaa

SEQ ID NO: 2305 - RNA, 2136 nt, Artificial Sequence
  KU501217.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaaaucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaa

SEQ ID NO: 2306 - RNA, 2136 nt, Artificial Sequence
  KU312314.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugccccaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccuggcucaaauggccguggauaugcagacccucacacccgugggccgccugaucaccgcgaacccuguuaucacggaauccacagagaauagcaagaugaugcuugagcuggacccucccuucggggauucuuacauugucaucggcgugggagagaaaaagauuacccaccacuggcaucgguccggcagcacaaucgggaaagccuuugaagcuaccgugagaggagccaagcgcauggcuguccucggcgacaccgccugggauuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgacgucgggugcuccguggauuuuagcaaa

SEQ ID NO: 2307 - RNA, 2136 nt, Artificial Sequence
  KX446950.2 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuacccuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaauaccaagaacgggagcaucucccugaugugucuugcccugggaggcguucucauuuuccugagcacagcugugucugccgacgucgggugcuccguggauuuuagcaaa

SEQ ID NO: 2308 - RNA, 2136 nt, Artificial Sequence
  KY003157.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccguggucucugcugacguggggugcuccguugauuuuagcaaa

SEQ ID NO: 2309 - RNA, 2136 nt, Artificial Sequence
  KX811222.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccgcuugggucguguauggaaccugucaucacaagaaaggcgaggcccggcgcucuagacgggcgguuacgcuucccagccauuccacccgcaagcugcaaacaagaccucagaccuggcucgagucucgggaauacacaaagcaccugauccgcguggagaacuggaucuuuagaaaucccggcuucgcccuggcugccgcugccauugcguggcuccuggggagcuccaccagccagaaagucaucuaucuugugaugauucugcucaucgccccugcuuacucuauucggugcaucggaguuuccaaccgcgauuuuguggaaggcaugagcgggggaacgugggucgacguggugcuggagcauggcgggugugucacaguuauggcccaggauaagcccaccguggacauugagcuugugacaaccaccgucucuaauauggcugaagugagauccuacugcuaugaggccagcaucucugauauggccuccgacagccgguguccuacacaaggagaggcuuaccuggacaaacaguccgauacgcaguauguuugcaagagaacccucguggaccgcggcuggggcaacggguguggacuguucggcaaagggucucuggucacaugcgcgaaguuugccugcagcaagaaaaugaccggaaaguccauccagccggagaaucucgaauaccggauuaugcugagcgugcacggcucucaacacuccgggaugaucguuaacgauacaggacaugagaccgacgagaauagagcuaaaguggaaauuacgcccaacagcccucgcgccgaggccacacuuggcggcuucgggucucugggacucgauugugaaccccggaccggccuggacuuuagcgaucuuuauuaccugaccaugaauaacaagcacuggcucguccauaaagagugguuccacgacaucccucugcccuggcacgcuggggccgauacaggaaccccgcauuggaauaacaaggaagcgcugguggaguuuaaagacgcucacgccaagagacagacagucgugguucucggcucccaggagggggccgugcauacggcucuggccggcgcucuugaagccgagauggauggagcgaagggccgccugucuagcgggcaccucaaaugccggcugaagauggacaaacuuagacugaagggagucuccuauagccucuguaccgccgcuuucacauuuaccaaaauuccugccgaaacacugcauggcaccgugacgguugaggugcaguacgcugggaccgacggacccugcaaggucccugcccaaauggcgguggauaugcagacacugacccccgugggccgccucaucacagccaaccccguuaucaccgaaucuacggaaaauuccaagaugaugcuggagcuugacccuccguucggggauagcuacauugucaucggcgugggagagaaaaagauuacacaccacuggcaucggucuggcuccaccaucgggaaggcuuuugaagccacagugagaggagcuaaacgcauggccguccugggcgacaccgccugggauuucgggagcgugggaggcgcucucaacucccuggggaaaggcauucaccagaucuucggagcggccuuuaagucucuguucggcgggaugagcugguuuucccaaauccuuauuggaacccuccugauguggcugggccucaauacaaagaacgggucuaucagccugaugugucuugcucugggaggcguucucauuuuccuguccacggccgugagcgccgacgucgggugcucuguggauuuuuccaaa

SEQ ID NO: 2310 - RNA, 2136 nt, Artificial Sequence
  KX447516.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucuaaaaaggucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaaaccuacaguggacauugagcuugugaccaccacagucuccaauauggccgaagugagaagcuacugcuaugaggcuucuaucuccgauauggccagcgacucccggugucccacgcagggagaagccuaccuggacaagcaaucugauacccaguauguuugcaaaagaacacucguggaccgcggcuggggcaacggguguggacuguucggcaaggggagccuggugaccugcgcuaaguuugcgugcuccaaaaagaugacaggaaaaagcauccagccugagaaucucgaauaccggauuaugcugucuguccacggcucccagcacagcgggaugaucguuaacgauaccggacaugagacggacgagaauagagccaagguggaaauuacaccgaacucuccccgcgcugaggccacccuuggcggcuucgggagccugggacucgauugugaaccucggaccggccuggacuuuuccgaucuuuauuaccugacaaugaauaacaaacacuggcucguccauaaggagugguuccacgacaucccccugccuuggcacgccggggcugauaccggaacaccccauuggaauaacaaagaagcccugguggaguuuaaggacgcgcacgcuaagagacaaacggucgugguucucggcucucaggagggggccgugcauaccgcccuggcuggcgcccuugaagcugagauggauggagccaaaggccgccugagcuccgggcaccucaagugccggcugaaaauggacaaacuuagacugaagggagucagcuauucucucuguacagcggccuucaccuuuacaaagauuccggcugaaacccugcauggcacggugaccguugaggugcaguacgccgggacagacggaccuugcaagguccccgcucagauggccguggauaugcaaacccugacaccugugggccgccucaucaccgcgaaccccguuaucacggaauccacagagaauagcaaaaugaugcuggagcuugaucccccuuucggggacucuuacauugucaucggcgugggagaaaagaaaauuacccaccacuggcaucgguccggcagcacaaucgggaaggccuuugaggcuaccgugagaggagccaaacgcauggcuguccugggcgacaccgccugggauuucggguccgugggaggcgcccucaacucucuggggaagggcauucaccagaucuucggagcugcguuuaagagccuguucggcgggauguccugguuuucucagauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaag

SEQ ID NO: 2311 - RNA, 2136 nt, Artificial Sequence
  KX520666.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgcggcagaaagucaucuaucuugugaugauucugcucaucgcgcccgccuacucuauucgcugcaucggaguuuccaacagagauuuuguggaaggcaugagcgggggaacaugggucgacguggugcuggagcauggcgggugugucaccguuauggcucaggauaagccuacaguggacauugagcuugugaccaccacagucucuaauauggccgaagugcgguccuacugcuaugaggcuagcaucucugauauggccuccgacagcagaugucccacgcaaggagaagccuaccuggacaaacaguccgauacccaguauguuugcaagcgcacacucguggaccggggcuggggcaacggguguggacuguucggcaaagggucucuggugaccugcgcuaaguuugcgugcagcaagaaaaugacaggaaaguccauccagccugagaaucucgaauacagaauuaugcugagcguccacggcucucaacacuccgggaugaucguuaacgauaccggacaugagacggacgagaaucgcgccaaaguggaaauuacaccgaacagcccccgggcugaggccacccuuggcggcuucgggucucugggacucgauugugaaccuagaaccggccuggacuuuagcgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcgccagacggucgugguucucggcucccaggagggggccgugcauaccgcccuggcuggcgcccuugaagcugagauggauggagccaagggccggcugucuagcgggcaccucaaaugcagacugaagauggacaaacuucgccugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccggcucaucaccgcgaaccccguuaucacggaaucuacagaaaauuccaagaugaugcuggagcuugaucccccuuucggggacagcuacauugucaucggcgugggagagaaaaagauuacccaccacuggcauagaucuggcuccacaaucgggaaagccuuugaggcuaccgugcgcggagccaagcggauggcuguccugggcgacaccgccugggauuucgggagcgugggaggcgcccucaacucccuggggaaaggcauucaccagaucuucggagcugcguuuaagucucuguucggcgggaugagcugguuuucccaaauccuuauuggaacacuccugauguggcugggccucaauacgaagaacgggucuaucagccugaugugucuugcccugggaggcguucucauuuuccuguccaccgcugugagcgccgacgucgggugcucuguggauuuuuccaaa

SEQ ID NO: 2312 - RNA, 2136 nt, Artificial Sequence
  KU729218.1 prME-long CDS opt
agaaucauuaacgcccggaaggagaaaaagcgcagaagcgcugacaccuccgugggcaucgucgggcugcuccugacaacggccauggcggcugaaguuacccggcgcggaucugccuacuauauguaccuugauagaaaugacgccggcgaggcuauuagcuuccccacaacccuggggaugaacaaaugcuauauccagauuauggaucucggacacaugugugacgccacaauguccuacgaaugcccuaugcuggaugagggcguggaaccggacgauguggacuguuggugcaauaccacaucuaccugggucguguaugggacgugucaucacaagaaaggagaggcucggcgcagcagacgggccguuacccuucccucccauucuacacgcaagcugcaaaccagaagccagacauggcucgagucccgggaauacaccaagcaccugauccgcguggagaacuggaucuuuagaaauccuggcuucgcgcuggccgcugccgcuauugccuggcuccugggcagcucuacgucccagaaagucaucuaucuugugaugauucugcucaucgcgcccgccuacagcauucggugcaucgggguuucuaaccgcgauuuuguggaaggaauguccggcgggacaugggucgacguggugcuggagcauggaggcugugucaccguuauggcucaggauaagccuacaguggacauugagcuugugaccaccacagucagcaauauggccgaagugagaucuuacugcuaugaggcuuccaucagcgauauggccuccgacucucggugucccacgcaaggggaagccuaccuggacaaacagagcgauacccaguauguuugcaagagaacacucguggaccgcggauggggcaacggcugugggcuguucggaaaaggcucccuggugaccugcgcuaaguuugcgugcagcaagaaaaugacagggaagucuauccagccugagaaucucgaauaccggauuaugcuguccgugcacggaagccaacacucuggcaugaucguuaacgauaccgggcaugagacggacgagaauagagccaaaguggaaauuacaccgaacagcccccgcgcugaggccacccuuggaggcuucggcucccuggggcucgauugugaaccucggaccggacuggacuuuucugaucuuuauuaccugacaaugaauaacaagcacuggcucguccauaaagagugguuccacgacaucccccugccuuggcacgccggcgcugauaccgggacaccccauuggaauaacaaggaagcccugguggaguuuaaagacgcgcacgcuaagagacagacggucgugguucucggaagccaggagggcgccgugcauaccgcccuggcuggggcccuugaagcugagauggauggcgccaagggacgccuguccagcggccaccucaaaugccggcugaagauggacaaacuuagacugaagggggucucuuauucccucuguacagcggccuucaccuuuacaaaaauuccggcugaaacccugcauggaacggugaccguugaggugcaguacgccggcacagacgggccuugcaagguccccgcucaaauggccguggauacccagacacugaccccugugggacgccucaucacggcgaaccccguuaucacagaaagcaccgaaaauucuaagaugaugcuggagcuugaucccccuuucggcgacuccuacauugucaucggggugggcgagaaaaagauuacacaccacuggcaucggagcggauccaccaucggcaaagccuuugaggcuaccgugagaggggccaagcgcauggcuguccugggagacacagccugggauuucggcucugucgggggagcccucaacagccugggcaaagggauucaccagaucuucggcgcugcguuuaagucccuguucggaggcaugucuugguuuagccaaauccuuauugggacgcuccugauguggcugggacucaauaccaagaacggcuccaucagccugaugugucuugcccucgggggaguucugauuuuccugucuacagcuguguccgccgacgucggcugcagcguggauuuuucuaaa

SEQ ID NO: 2313 - RNA, 2136 nt, Artificial Sequence
  KU761561.1 prME-long CDS opt
agaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggaucuuuagaaacccuggcuucgcgcuggccgcugccgcuauugccuggcuccuggggagcuccacgagccagaaagucaucuaucuugugaugauucugcucaucgcgcccgccuacucuauucggugcaucggaguuuccaaucgcgauuuuguggaaggcaugagcgggggaacaugggucgacguggugcuggagcauggcgggugugucaccguuauggcucaggauaagccuacaguggacauugagcuugugaccaccacagucucuaacauggccgaagugagauccuacugcuaugaggcuagcaucucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggauuaugcugagcguccacggcucucaacacuccgggaugaucguuaaugauaccggacaugagacggacgagaacagagccaaaguggaaauuacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacaucccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaucccguuaucacggaaucuacagagaacuccaagaugaugcuggagcuugaucccccuuucggggacagcuacauugucaucggcgugggagagaaaaagauuacccaccacuggcaucggucuggcuccacaaucgggaaagccuuugaagcuaccgugagaggagcccgccggauggcuguccugggcgacaccgccugggauuucgggagcgugggaggcgcccucaauucccuggggaagggcauucaccagaucuucggagcugcguuuaaaucucuguucggcgggaugagcugguuuucccaaauccuuauuggaacacuccugauguggcugggccucaacacgaagaaugggucuaucagccugaugugucuugcccugggaggcguucucauuuuccuguccaccgcugugagcgccgacgucgggugcucuguggauuuuuccaag

SEQ ID NO: 2314 - RNA, 2136 nt, Artificial Sequence
  KY317938.1 prME-long CDS opt
agaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgacuuuguggagggcaugucugggggaacaugggucgauguggugcuggagcauggcgggugugucaccguuauggcucaggacaagccuacaguggauauugaacuugugaccaccacagucuccaauauggccgaggugagaagcuacugcuaugaggcuucuaucuccgacauggccagcgauucccggugucccacgcaaggagaagccuaccuggacaaacagucugacacccaguauguuugcaagagaacacucguggaucgcggcuggggcaacggguguggacuguucggcaaagggagccuggugaccugcgcuaaguuugcgugcuccaagaaaaugacaggaaagagcauccagccugaaaaucucgaguaccggauuaugcugucuguccacggcucccaacacagcgggaugaucguuaacgacaccggacaugagacggaugaaaauagagccaaaguggagauuacaccgaacucuccccgcgcugaagccacccuuggcggcuucgggagccugggacucgacugugagccucggaccggccuggauuuuuccgaccuuuauuaccugacaaugaauaacaagcacuggcucguccauaaagaaugguuccacgauaucccccugccuuggcacgccggggcugacaccggaacaccccauuggaauaacaaggaggcccugguggaguuuaaagaugcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaa

SEQ ID NO: 2315 - RNA, 2136 nt, Artificial Sequence
  KY075939.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacucccugcggugcauuggaguuagcaaccgcgauuuuguggaaggcaugucugggggaacaugggucgacguggugcuugagcauggcgggugugucaccguuauggcucaggauaagccuacaguggacaucgagcuggugaccaccacagucuccaauauggccgaagugagaagcuacugcuaugaggcuucuauuuccgauauggccagcgacucccggugucccacgcaaggagaagccuaccucgacaaacagucugauacccaguauguuugcaagagaacacugguggaccgcggcuggggcaacggguguggacuguucggcaaagggagccucgugaccugcgcuaaguuugcgugcuccaagaaaaugacaggaaagagcauccagccugagaaucuggaauaccggaucaugcuuucuguccacggcucccaacacagcgggaugauuguuaacgauaccggacaugagacggacgagaauagagccaaaguggaaaucacaccgaacucuccccgcgcugaggccacccugggcggcuucgggagccucggacuggauugugaaccucggaccggccuugacuuuuccgaucuguauuaccucacaaugaauaacaagcacuggcugguccauaaagagugguuccacgacauuccccugccuuggcacgccggggcugauaccggaacaccccauuggaauaacaaggaagcccucguggaguuuaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuucaccuuuacaaaaaucccggcugaaacccugcauggcacggugaccguugaggugcaguacgccgggacagacggaccuugcaagguccccgcucaaauggccguggauaugcagacccucacaccugugggccgccugauuaccgcgaaccccguuaucacggaauccacagagaauagcaagaugaugcuugagcuggaucccccuuucggggacucuuacaucgucauuggcgugggagagaaaaagaucacccaccacuggcaucgguccggcagcacaauugggaaagccuuugaagcuaccgugagaggagccaagcgcauggcuguccucggcgacaccgccugggauuucggguccgugggaggcgcccugaacucucuggggaaaggcauccaccagauuuucggagcugcguuuaagagccuuuucggcgggauguccugguuuucucaaauccucaucggaacacugcugauguggcucggccugaauacgaagaacgggagcauuucccuuaugugucuggcccucggaggcguucugaucuuccugagcaccgcugugucugccgacgucgggugcuccguggauuuuagcaaa

SEQ ID NO: 2316 - RNA, 2136 nt, Artificial Sequence
  KX806557.2 prME-long CDS opt
agaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggauguuuagaaacccuggcuucgcgcuggccgcugccgcuaucgccuggcuccuggggagcuccacgagccagaaagucauuuaucuugugaugauccugcucauugcgcccgccuacucuauccggugcauuggaguuuccaaucgcgauuuuguggaaggcaugagcgggggaacaugggucgacguggugcuggagcauggcgggugugucaccguuauggcucaggauaagccuacaguggacaucgagcuugugaccaccacagucucuaacauggccgaagugagauccuacugcuaugaggcuagcauuucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggaucaugcugagcguccacggcucucaacacuccgggaugauuguuaaugauaccggacaugagacggacgagaacagagccaaaguggaaaucacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacauuccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucauuaccgcgaaucccguuaucacggaaucuacagagaacuccaagaugaugcuggagcuugaucccccuuucggggacagcuacaucgucauuggcgugggagagaaaaagaucacccaccacuggcaucggucuggcuccacaauugggaaagccuuugaagcuaccgugagaggagccaagcgcauggcuguccugggcgacaccgccugggauuucgggagcgugggaggcgcccucaauucccuggggaaaggcauccaccagauuuucggagcugcguuuaagucucuguucggcgggaugagcugguuuucccaaauccuuaucggaacacuccugauguggcugggccucaacacgaagaaugggucuauuagccugaugugucuugcccugggaggcguucucaucuuccuguccaccgcugugagcgccgacgucgggugcucuguggauuuuuccaaa

SEQ ID NO: 2317 - RNA, 2136 nt, Artificial Sequence
  KU870645.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggauccugagaaauccuggcuuugcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcauuggagagaaaaagaucacccaccacuggcaucgguccggcagcacaauugggaaagccuucgaagcuaccgugagaggagccaagcgcauggcugugcucggcgacaccgccugggauuuuggguccgucggaggcgcccugaacucucuggggaaaggcauccaccagaucuucggagcugcguucaagagccuuuuuggcgggauguccugguucucucaaauucucaucggaacacugcugauguggcucggccugaauacgaagaacgggagcauuucccuuaugugucuggcccucggaggcgugcugaucuuucugagcaccgcuguuucugccgacguggggugcuccgucgauuucagcaaa

SEQ ID NO: 2318 - RNA, 2136 nt, Artificial Sequence
  KU729217.2 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuuguguccaccaccgucagcaauauggccgaagugagaucuuacugcuaugaggcuacaaucuccgauaucgccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggccgucgugcucggcucucaggagggggccguucauaccgcucuggccggcgcucuugaagccgagauggauggagcgaagggccgccugagcuccgggcaccucaaaugccggcugaagauggacaaacuuagacugaagggagugagcuauucucucuguacagccgcuuucaccuuuacaaaaaucccggccgaaacccugcauggcacggucaccguggagguucaguacgcugggacagacggaccuugcaaggugcccgcccaaauggcggucgauaugcagacccugacaccugugggccgccucaucaccgccaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaggcuuuugaagccaccgugagaggagcuaaacgcauggccgugcugggcgacaccgccugggauuucggguccgucggaggcgcucucaacucucuggggaaaggcauccaccagaucuucggagcggccuuuaagagccuguucggcgggauguccugguuuucucaaauucuuaucggaacacuccugauguggcugggccucaauacgaagaacgggagcauuucccugaugugucuugcucugggaggcgugcucaucuuccugagcaccgccguuucugccgacguggggugcuccgucgauuuuagcaaa

SEQ ID NO: 2319 - RNA, 2136 nt, Artificial Sequence
  KU497555.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcacccaggagggggccgugcauacagcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaaucuaccgaaaauuccaagaugaugcuggagcuugaucccccuuucggggacagcuacauugucaucggcgugggagagaaaaagauuacacaccacuggcaucggucuggcuccaccaucgggaaagccuuugaggcuaccgugagaggagccaagcgcauggcuguccugggcgacacagccugggauuucgggagcgugggaggcgcccucaacucccuggggaaaggcauucaccagaucuucggagcugcguuuaagucucuguucggcgggaugagcugguuuucccaaauccuuauuggaacgcuccugauguggcugggccucaauaccaagaacgggucuaucagccugaugugucuugcccugggaggcguucucauuuuccuguccacagcugugagcgccgacgucgggugcucuguggauuuuuccaaa

SEQ ID NO: 2320 - RNA, 2136 nt, Artificial Sequence
  KX087101.3 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugagcugcaguacgccgggacagacggaccuugcaaggugcccgcucaaauggccgucgauaugcagacccucacaccugugggccgccugaucaccgcgaaccccgugaucacggaauccacagagaauagcaagaugaugcuugagcuggaucccccuuucggggacucuuacauuguuaucggcgucggagagaaaaagauuacccaccacuggcaucgguccggcagcacaaucgggaaagccuuugaagcuaccgugagaggagccaagcgcauggcugugcucggcgacaccgccugggauuucggguccgucggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcgugcugauuuuccugagcaccgcuguuucugccgacguggggugcuccgucgauuuuagcaaa

SEQ ID NO: 2321 - RNA, 2136 nt, Artificial Sequence
  KY075932.1 prME-long CDS opt
agaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcaucgaaaacuggauuuuuagaaauccuggcuucgcgcuggccgcugccgcuaucgccuggcuccugggguccagcacgucucagaaagugauuuaucuugucaugauccugcucauugcgcccgccuacuccauccggugcauuggagugagcaaccgcgacuuuguugagggcaugucugggggaacauggguggaugucgugcuggagcauggcgggugugugaccgucauggcucaggacaagccuacaguugauaucgaacuugugaccaccacaguguccaauauggccgaggucagaagcuacugcuaugaggcuucuaucuccgacauggccagcgauucccggugucccacgcaaggagaagccuaccuggacaaacagucugacacccaguaugugugcaagagaacacucguugaucgcggcuggggcaacggguguggacuguucggcaaagggagccuggugaccugcgcuaaguuugcgugcuccaagaaaaugacaggaaagagcauucagccugaaaaucucgaguaccggaucaugcugucuguccacggcucccaacacagcgggaugauugugaacgacaccggacaugagacggaugaaaauagagccaaaguugagaucacaccgaacucuccccgcgcugaagccacccuuggcggcuucgggagccugggacucgacugugagccucggaccggccuggauuuuuccgaccuuuauuaccugacaaugaauaacaagcacuggcucgugcauaaagaaugguuccacgauauuccccugccuuggcacgccggggcugacaccggaacaccccauuggaauaacaaggaggcccuggucgaguuuaaagaugcgcacgcuaagagacagacgguggucgugcucggcucucaggaaggggccguucauaccgcccuggcuggcgcccuugaggcugaaauggacggagccaagggccgccugagcuccgggcaccucaaaugccggcugaagauggauaaacuuagacugaagggagugagcuauucucucuguacagcggccuucaccuuuacaaaaaucccggcugagacccugcauggcacggucaccguggaaguucaguacgccgggacagacggaccuugcaaggugcccgcucaaauggccgucgacaugcagacccugacaccugugggccgccucaucaccgcgaaccccgugauuacggaguccacagagaauagcaagaugaugcuggaacuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgauaccgccugggacuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgauguggggugcuccgucgacuuuagcaaa

SEQ ID NO: 2322 - RNA, 2136 nt, Artificial Sequence
  KY014317.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccauugagaauagcaagaugaugcuggagcuugaucccccuuucggggacucuuacaucgucauuggcgugggagagaaaaagaucacacaccacuggcaucgguccggcagcaccauugggaaagccuuugaagcuacagugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacccuccugauguggcugggccucaauacaaagaacgggagcauuucccugaugugucuugcccugggaggcguucucaucuuccugagcacggcugugucugccgacgucgggugcuccguggauuuuagcaaa

SEQ ID NO: 2323 - RNA, 2136 nt, Artificial Sequence
  KU758876.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagucaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucuccuucaugugucuggcgcuuggaggcgugcugauuuuucucagcaccgccgucucugcugacguggggugcuccguugauuucagcaaa

SEQ ID NO: 2324 - RNA, 2136 nt, Artificial Sequence
  KU758874.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggcaaacugagcuccgggcaccucaagugccgccugaaaauggacaaacuucggcugaagggagucagcuauucucucuguacagcggccuucaccuuuacaaagauuccggcugaaacccugcauggcacggugaccguugaggugcaguacgccgggacagacggaccuugcaagguccccgcucaaauggccguggauaugcagacccugacaccugugggcagacucaucaccgcgaaccccguuaucacggaauccacagagaauagcaaaaugaugcuggagcuugaucccccuuucggggacucuuacauugucaucggcgugggagaaaagaaaauuacccaccacuggcaucgcuccggcagcacaaucgggaaggccuuugaggcuaccgugcggggagccaaaagaauggcuguccugggcgacaccgccugggauuucggguccgugggaggcgcccucaacucucuggggaagggcauucaccagaucuucggagcugcguuuaagagccuguucggcgggauguccugguuuucucaaauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaag

SEQ ID NO: 2325 - RNA, 2136 nt, Artificial Sequence
  KY014314.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagaggcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaa

SEQ ID NO: 2326 - RNA, 2136 nt, Artificial Sequence
  KU926310.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccggggcugacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaa

SEQ ID NO: 2327 - RNA, 2136 nt, Artificial Sequence
  KU761560.1 prME-long CDS opt
agaaucauuaacgccggcaaggagaaaaagcggcgcggggcugacaccaaugugggaaucgucggccugcuccugacaacggccauggcggcugaaguuaccagacgggggagcgccuacuauauguaccuugaucgcaacgacgccggagaggcuauuuccuuccccacaacccugggcaugaauaaaugcuauauccagauuauggaucucgggcacaugugugacgccacaaugucuuacgaaugcccuaugcuggaugagggaguggaaccggacgauguggacuguuggugcaacaccacaagcaccugggucguguauggcacgugucaucacaagaaaggcgaggcuagacggucccgcagagccguuacccuucccucucauagcacacggaagcugcaaacccgcucccagacauggcucgagucuagagaauacaccaagcaccugauccggguggagaauuggaucuuucgcaacccuggguucgcgcuggccgcugccgcuauugccuggcuccugggaagcuccacgagccagaaagucaucuaucuugugaugauucugcucaucgcgcccgccuacucuauuagaugcaucggcguuuccaaucgggauuuuguggaagggaugagcggaggcacaugggucgacguggugcuggagcaugggggaugugucaccguuauggcucaggauaagccuacaguggacauugagcuugugaccaccacagucucuaacauggccgaagugcgcuccuacugcuaugaggcuagcaucucugauauggccuccgacagcagaugucccacgcaaggcgaagccuaccuggacaaacaguccgauacccaguauguuugcaagcggacacucguggacagaggcugggggaauggauguggccuguucgggaaaggaucucuggugaccugcgcuaaguuugcgugcagcaagaaaaugacaggcaaguccauccagccugagaaccucgaauaccgcauuaugcugagcguccacgggucucaacacuccggaaugaucguuaaugauaccggccaugagacggacgagaaccgggccaaaguggaaauuacaccgaauagccccagagcugaggccacccuuggcggguucggaucucugggccucgauugugaaccucgcaccgggcuggacuuuagcgaucuuuauuaccugacaaugaacaauaagcacuggcucguccauaaagagugguuccacgacaucccccugccuuggcacgccggagcugauaccggcacaccccauuggaacaacaaggaagcccugguggaguuuaaagacgcgcacgcuaagcggcagacggucgugguucucgggucccaggagggcgccgugcauaccgcccuggcuggagcccuugaagcugagauggauggcgccaaggggagacugucuagcggacaccucaaaugccgccugaagauggacaaacuucggcugaagggcgucuccuauagccucuguacagcggccuucaccuuuacaaaaauuccggcugaaacccugcaugggacggugaccguugaggugcaguacgccggaacagacggcccuugcaagguccccgcucaaauggccguggauaugcagacccugacaccuguggggagacucaucaccgcgaaucccguuaucacggaaucuacagagaacuccaagaugaugcuggagcuugaucccccuuucggcgacagcuacauugucaucggagugggcgagaaaaagauuacccaccacuggcaucgcucuggguccacaaucggaaaagccuuugaagcuaccgugcggggcgccagacgcauggcuguccugggggacaccgccugggauuucggaagcgugggcggggcccucaauucccugggcaagggcauucaccagaucuucggagcugcguuuaaaucucuguucgggggaaugagcugguuuucccaaauccuuauuggcacacuccugauguggcuggggcucaacacgaagaauggaucuaucagccugaugugucuugcccugggcgggguucucauuuuccuguccaccgcugugagcgccgacgucggcugcucuguggauuuuuccaag

SEQ ID NO: 2328 - RNA, 2136 nt, Artificial Sequence
  KY317939.1 prME-long CDS opt
agaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaagaugccggggaagcuauuucuuuccccacaacccugggaaugaauaagugcuauauccagauuauggaccucggccacaugugugaugccacaaugagcuacgagugcccuaugcuggacgaagggguggagccggaugacguggauuguuggugcaacaccacauccaccugggucguguauggaacgugucaucacaaaaagggcgaggcucggcgcucuagacgggccguuacccuucccagccauuccacacgcaagcugcaaaccagaucucagacauggcucgaaagccgggaguacaccaaacaccugauccgcguggaaaauuggaucuuuagaaacccuggcuucgcgcuggccgcugccgcuauugccuggcuccugggguccagcacgucucagaaggucaucuaucuugugaugauucugcucaucgcgcccgccuacuccauucggugcaucggaguuagcaaucgcgacuuuguggagggcaugucugggggaacaugggucgauguggugcuggagcauggcgggugugucaccguuauggcucaggacaaaccuacaguggauauugaacuugugaccaccacagucuccaacauggccgaggugagaagcuacugcuaugaggcuucuaucuccgacauggccagcgauucccggugucccacgcaaggagaagccuaccuggacaagcagucugacacccaguauguuugcaaaagaacacucguggaucgcggcuggggcaauggguguggacuguucggcaaggggagccuggugaccugcgcuaaguuugcgugcuccaaaaagaugacaggaaaaagcauccagccugaaaaccucgaguaccggauuaugcugucuguccacggcucccaacacagcgggaugaucguuaaugacaccggacaugagacggaugaaaacagagccaagguggagauuacacccaauucuccgcgcgcugaagccacccuuggcggcuucgggagccugggacucgacugugagccucggaccggccuggauuuuuccgaccuuuauuaccugacaaugaacaauaaacacuggcucguccauaaggaaugguuccacgauaucccccugccuuggcacgccggggcugacaccggaacaccccauuggaacaauaaagaggcccugguggaguuuaaggaugcgcacgcuaagagacagacggucgugguucucggcucucaggaaggggccgugcauaccgcccuggcuggcgcccuugaggcugaaauggacggagccaaaggccgccugagcuccgggcaccucaagugccggcugaaaauggauaaacuuagacugaagggagucagcuauucucucuguacagcggccuucaccuuuacaaagauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaacagcaaaaugaugcuggaacuugaucccccuuucggggacucuuacauugucaucggcgugggagagaagaaaauuacccaccacuggcaucgguccggcagcacaaucgggaaggccuuugaagcuaccgugagaggagccaaacgcauggcuguccugggcgauaccgccugggacuucggguccgugggaggcgcccucaauucucuggggaagggcauucaccagaucuucggagcugcguuuaagagccuguucggcgggauguccugguuuucucaaauccuuauuggaacacuccugauguggcugggccucaacacgaaaaaugggagcaucucccugaugugucuugcccugggaggcguucucauuuuccugagcaccgcugugucugccgaugucgggugcuccguggacuuuagcaag

SEQ ID NO: 2329 - RNA, 2136 nt, Artificial Sequence
  KY075937.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauaugguuagcgacucccggugucccacgcaaggagaagccuaccuggacaaacagucugauacccaguaugugugcaagagaacacucgucgaccgcggcuggggcaacggguguggacuguucggcaaagggagccuggugaccugcgccaaguuugcuugcuccaagaaaaugacaggaaagagcauccagccugagaaucucgaauaccggauuaugcugucuguucacggcucccaacacagcgggaugaucgugaacgauaccggacaugagacggacgagaauagagcgaaagucgaaauuacaccgaacucuccccgcgccgaggcuacccuuggcggcuucgggagccugggacucgauugugaaccucggaccggccuggacuuuuccgaucuuuauuaccugacaaugaauaacaagcacuggcucgugcauaaagagugguuccacgacaucccccugccuuggcacgccggggccgauaccggaacaccccauuggaauaacaaggaagcucuggucgaguuuaaagacgcccacgcgaagagacagacggugguugugcucggcucucaggagggggcuguccauaccgcccuggccggcgcucuugaagccgagauggauggagcuaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucucccugaugugucuugcgcugggaggcgugcucauuuuccugagcaccgccgucucugcugacguggggugcuccguugauuuuagcaaa

SEQ ID NO: 2330 - RNA, 2136 nt, Artificial Sequence
  LC191864.1 prME-long CDS opt
agaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaugaccagcacaugggucguguauggaaccugucaucacaagaaaggcgaggcucggcgcuccagacgggccguuacgcuucccucucauagcacccgcaagcugcaaacaagaucccagaccuggcucgagucucgggaauacacaaagcaccugauccgcguggagaauuggaucuuuagaaacccuggcuucgcgcuggccgcugccgcuauugccuggcuccuggggagcuccaccagccagaaagucaucuaucuugugaugauucugcucaucgcgcccgccuacucuauucggugcaucggaguuuccaaucgcgauuuuguggaaggcaugagcgggggaacgugggucgacguggugcuggagcauggcgggugugucacaguuauggcucaggauaagccuaccguggacauugagcuugugacaaccaccgucucuaacauggccgaagugagauccuacugcuaugaggcuagcaucucugauauggccuccgacagccggugucccacacaaggagaagccuaccuggacaaacaguccgauacgcaguauguuugcaagagaacccucguggaccgcggcuggggcaauggguguggacuguucggcaaagggucucuggucacaugcgcuaaguuugcgugcagcaagaaaaugaccggaaaguccauccagccugagaaccucgaauaccggauuaugcugagcgugcacggcucucaacacuccgggaugaucguuaaugauacaggacaugagaccgacgagaacagagccaaaguggaaauuacgccgaauagcccccgcgcugaggccacacuuggcggcuucgggucucugggacucgauugugaaccucggaccggccuggacuuuagcgaucuuuauuaccugaccaugaacaauaagcacuggcucguccauaaagagugguuccacgacaucccccugccuuggcacgccggggcugauacaggaacaccccauuggaacaacaaggaagcccugguggaguuuaaagacgcgcacgcuaagagacagaccgucgugguucucggcucccaggagggggccgugcauacggcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacacugcauggcaccgugacgguugaggugcaguacgccgggaccgacggaccuugcaagguccccgcucaaauggccguggauaugcagacacugaccccugugggccgccucaucacagcgaaucccguuaucaccgaaucuacggagaacuccaagaugaugcuggagcuugaucccccuuucggggacagcuacauugucaucggcgugggagagaaaaagauuacacaccacuggcaucggucuggcuccaccaucgggaaagccuuugaagcuacagugagaggagccaagcgcauggcuguccugggcgacaccgccugggauuucgggagcgugggaggcgcccucaauucccuggggaaaggcauucaccagaucuucggagcugcguuuaagucucuguucggcgggaugagcugguuuucccaaauccuuauuggaacccuccugauguggcugggccucaacacaaagaaugggucuaucagccugaugugucuugcccugggaggcguucucauuuuccuguccacggcugugagcgccgacgucgggugcucuguggauuuuuccaaa

SEQ ID NO: 2331 - RNA, 2136 nt, Artificial Sequence
  KX447517.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccgcccuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaacccuuaucggaacacuccugauguggcugggccucaauacgaagaacgggagcauuucccugaugugucuugcucugggaggcguucucaucuuccugagcaccgccgugucugccgacgucgggugcuccguggauuuuagcaaa

SEQ ID NO: 2332 - RNA, 2136 nt, Artificial Sequence
  KU922923.1 prME-long CDS opt
agaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugccccaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcuggccuacuccauucggugcaucggaguuagcaaccgcgacuuuguggagggcaugucugggggaacaugggucgauguggugcuugagcauggcgggugugucaccguuauggcucaggacaagcccacaguggauauugaacuggugaccaccacagucuccaauauggccgaggugagaagcuacugcuaugaggcuucuaucuccgacauggccagcgauucccgguguccuacgcaaggagaagccuaccucgacaaacagucugacacccaguauguuugcaagagaacacugguggaucgcggcuggggcaacggguguggacuguucggcaaagggagccucgugaccugcgcuaaguuugcgugcuccaagaaaaugacaggaaagagcauccagcccgaaaaucuggaguaccggauuaugcuuucuguccacggcucccaacacagcgggaugaucguuaacgacaccggacaugagacggaugaaaauagagccaaaguggagauuacaccuaacucuccgcgcgcugaagccacccugggcggcuucgggagccucggacuggacugugagccccggaccggccuugauuuuuccgaccuguauuaccucacaaugaauaacaagcacuggcugguccauaaagaaugguuccacgauaucccucugcccuggcacgccggggcugacaccggaacaccucauuggaauaacaaggaggcccucguggaguuuaaagaugcgcacgcuaagagacagacggucgugguucugggcucucaggaaggggccgugcauaccgcccuugcuggcgcccuggaggcugaaauggacggagccaagggccgccucagcuccgggcaccugaaaugccggcuuaagauggauaaacugagacucaagggagucagcuauucucuguguacagcggccuucaccuuuacaaaaauucccgcugagacccugcauggcacggugaccguugaagugcaguacgccgggacagacggaccgugcaaggucccugcucaaauggccguggacaugcagacccucacacccgugggccgccugaucaccgcgaacccuguuaucacggaguccacagagaauagcaagaugaugcuugaacuggauccucccuucggggacucuuacauugucaucggcgugggagagaaaaagauuacccaccacuggcaucgguccggcagcacaaucgggaaagccuuugaagcuaccgugagaggagccaagcgcauggcuguccucggcgauaccgccugggacuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgaugucgggugcuccguggacuuuagcaaa

SEQ ID NO: 2333 - RNA, 2136 nt, Artificial Sequence
  KY003156.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaauuagcaaccgcgauuuuguugaaggcaugucugggggaacauggguggacgucgugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggauucugggacucgauugugaaccucggaccggccuggacuuuagcgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagagacagacgguggucgugcucggcucccaggagggggccguucauaccgcccuggcuggcgcccuugaagcugagauggauggagccaagggccgccugucuagcgggcaccucaaaugccggcugaagauggacaaacuuagacugaagggaguguccuauagccucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucauuaccgcgaaccccgugaucacggaaucuacagaaaauuccaagaugaugcuggagcuugaucccccuuucggggacagcuacauuguuaucggcgucggagagaaaaagauuacccaccacuggcaucggucuggcuccacaaucgggaaagccuuugaggcuaccgugagaggagccaagcgcauggcugugcugggcgacaccgccugggauuucgggagcgucggaggcgcccucaacucccuggggaaaggcauccaccagauuuucggagcugcguuuaagucucuguucggcgggaugagcugguuuucccaaauccuuauuggaacacuccugauguggcugggccucaauacgaagaacgggucuaucagccugaugugucuugcccugggaggcgugcucauuuuccuguccaccgcuguuagcgccgacguggggugcucugucgauuuuuccaaa

SEQ ID NO: 2334 - RNA, 2136 nt, Artificial Sequence
  KU312313.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccauccgcaagcugcaaaccagaucucagacauggcucgagagccgggaauacaccaagcaccugauccgcguggagaacuggauuuuuagaaauccuggcuucgcgcuggccgcugccgcuaucgccuggcuccugggguccagcacgucucagaaagucauuuaucuugugaugauccugcucauugcgcccgccuacuccauccggugcauuggaguuagcaaccgcgauuuuguggaaggcaugucugggggaacaugggucgacguggugcuggagcauggcgggugugucaccguuauggcucaggauaagccuacaguggacaucgagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucaucaccgcgaaccccguuauuacggaauccacagagaauagcaagaugaugcuggagcuugaucccccuuucggggacucuuacaucgucauuggcgugggagagaaaaagaucacccaccacuggcaucgguccggcagcacaauugggaaagccuuugaagcuaccgugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacacuccugauguggcugggccucaaugccaagaacgggagcauuucccugaugugucuugcucugggaggcguucucaucuuccugagcacggccgugucugccgacgucgggugcuccguggauuuuagcaaa

SEQ ID NO: 2335 - RNA, 2136 nt, Artificial Sequence
  KY075935.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucaacggucucgcagagccguuacccuucccagccauuccacacggaagcugcagacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacguggugcuggagcauggcgggugugucaccguuauggcucaagauaagccuacaguggacauugagcuugugaccaccacagucuccaauauggccgaagugcgcagcuacugcuaugaggcuucuaucuccgauauggccagcgacuccagaugucccacgcagggagaagccuaccuggacaaacagucugauacccaguauguuugcaagcggacacucguggacagaggcuggggcaacggguguggacuguucggcaaagggagccuggugaccugcgcuaaguuugcgugcuccaagaaaaugacaggaaagagcauccaaccugagaaucucgaauaccgcauuaugcugucuguccacggcucccagcacagcgggaugaucguuaacgauaccggacaugagacggacgagaaucgggccaaaguggaaauuacaccgaacucucccagagcugaggccacccuuggcggcuucgggagccugggacucgauugugaaccucgcaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcggcagacggucgugguucucggcucucaggagggggccgugcauaccgcccuggcuggcgcccuugaagcugagauggauggagccaagggcagacugagcuccgggcaccucaaaugccgccugaagauggacaaacuucggcugaagggagucagcuauucucucuguacagcggccuucaccuuuacaaaaauuccggcugaaacccugcauggcacggugaccguugaggugcaauacgccgggacagacggaccuugcaagguccccgcucagauggccguggauaugcagacccugacaccugugggcagacucaucaccgcgaaccccguuaucacggaauccacagagaauagcaagaugaugcuggagcuugaucccccuuucggggacucuuacauugucaucggcgugggagagaaaaagauuacccaccacuggcaucgcuccggcagcacaaucgggaaagccuuugaagcuaccgugcggggagccaagagaauggcuguccugggcgacaccgccugggauuucggguccgugggaggcgcccucaacucucuggggaaaggcauucaccaaaucuucggagcugcguuuaagagccuguucggcgggauguccugguuuucucagauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaa

SEQ ID NO: 2336 - RNA, 2136 nt, Artificial Sequence
  KY014320.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaagcgagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaa

SEQ ID NO: 2337 - RNA, 2136 nt, Artificial Sequence
  KX827309.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaucugacgccggggaggcuauuagcuuccccacaacccugggaaugaauaaaugcuauauccagauuauggaucucggccacaugugugacgccacaauguccuacgaaugcccuaugcuggaugaggggguggaaccggacgauguggacuguuggugcaacaccacaucuaccugggucguguauggaacgugucaucacaagaaaggcgaggcucggcgcagcagacgggccguuacccuucccucccauucuacacgcaagcugcaaaccagaagccagacauggcucgagucccgggaauacaccaagcaccugauccgcguggagaauuggaucuuuagaaacccuggcuucgcgcuggccgcugccgcuauugccuggcuccuggggagcucuacgucccagaaagucaucuaucuugugaugauucugcucaucgcgcccgccuacagcauucggugcaucggaguuucuaaucgcgauuuuguggaaggcauguccgggggaacaugggucgacguggugcuggagcauggcgggugugucaccguuauggcucaggauaagccuacaguggacauugagcuugugaccaccacagucagcaacauggccgaagugagaucuuacugcuaugaggcuuccaucagcgauauggccuccgacucucggugucccacgcaaggagaagccuaccuggacaaacagagcgauacccaguauguuugcaagagaacacucguggaccgcggcuggggcaauggguguggacuguucggcaaagggucccuggugaccugcgcuaaguuugcgugcagcaagaaaaugacaggaaagucuauccagccugagaaccucgaauaccggauuaugcuguccguccacggcagccaacacucugggaugaucguuaaugauaccggacaugagacggacgagaacagagccaaaguggaaauuacaccgaauagcccccgcgcugaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggcugauaccggaacaccccauuggaacaauaaggaagcccugguggaguuuaaagacgcgcacgcuaagagacagacggucgugguucucggcagccaggagggggccgugcauaccgcccuggcuggcgcccuugaagcugagauggauggagccaagggccgccuguccagcgggcaccucaaaugccggcugaagauggacaaacuuagacugaagggagucucuuauucccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaaagcacagagaacucuaagaugaugcuggagcuugaucccccuuucggggacuccuacauugucaucggcgugggagagaaaaagauuacccaccacuggcaucggagcggcuccacaaucgggaaagccuuugaagcuaccgugagaggagccaagcgcauggcuguccugggcgacaccgccugggauuucgggucugugggaggcgcccucaauagccuggggaaaggcauucaccagaucuucggagcugcguuuaagucccuguucggcgggaugucuugguuuagccaaauccuuauuggaacacuccugauguggcugggccucaacacgaagaauggguccaucagccugaugugucuugcccugggaggcguucucauuuuccugucuaccgcuguguccgccgacgucgggugcagcguggauuuuucuaaa

SEQ ID NO: 2338 - RNA, 2136 nt, Artificial Sequence
  KU681081.3 prME-long CDS opt
agaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacacaggggccgauacgggaacaccccauuggaacaauaaggaagcccugguggaguuuaaagacgcucacgccaagagacagaccgucgugguucucggcagccaggagggggcggugcauaccgcucuggccggcgcccuugaagcugagauggauggagccaagggccgccuguccagcgggcaccucaaaugccggcugaagauggacaaacuuagacugaagggagucucuuauucccucuguacagcugccuucaccuuuacgaaaauuccggcggaaacccugcauggcacagugaccguugaggugcaguacgccgggacagacggaccuugcaagguccccgcucaaauggccguggauaugcagacccugacgccugugggccgccucaucacagcuaaccccguuaucaccgaagggacagagaacagcaagaugaugcuggagcuugaucccccuuucggcgacucuuacauugucaucggagugggcgagaaaaagauuacccaccacuggcaucgguccgggagcaccaucggaaaagccuuugaagcgacagugagaggcgccaagcgcauggcuguccugggggacacggccugggauuucggauccgugggcgggguucucaauucucugggcaaaggcauucaccagaucuucggagcugccuuuaagagccuguucgggggaauguccugguuuucucaaauccuuauuggcacccuccugauguggcuggggcucaacacaaagaauggaagcaucucccugaugugucuugcccugggcggggugcucauuuuccugagcaccgcugucucugcggacgugggcugcuccguugauuuuagcaaa

SEQ ID NO: 2339 - RNA, 2136 nt, Artificial Sequence
  KU744693.1 prME-long CDS opt
agaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccgcuauggcccaggauaagccuacaguugacauugagcuugugaccaccacaguguccaauauggcugaagucagaagcuacugcuaugaggccucuaucuccgauauggccagcgacucccggugucccacgcaaggagaggcuuaccuggacaaacagucugauacccaguaugugugcaagagaacacucguugaccgcggcuggggcaacggguguggacuguucggcaaagggagccuggugaccugcgcgaaguuugccugcuccaagaaaaugacaggaaagagcauccagccugaaaaucucgaauaccggauuaugcugucuguccacggcucccaacacagcgggaugcuugugaacgauaccggacaugagacggacgagaauagagcuaaaguugaaaucacaccgaacucuccccgcgccgaggccacccugggcggcuucgggagccucggacuggauugugaaccucggaccggccuugacuuuuccgaucuguauuaccucacaaugaauaacaagcacuggcuggcucauaaagagugguuccacgacauuccccugccuuggcacgccggggcggcuaccggaacaccccauuggaauaacaaggaagcccucguggaguuuaaagaugcccacgcuaagagacagacggucgugguccugggcucucaggagggggccgugcauaccgcucuugccggcgcgcuggaagccgagauggacggagcuaagggccgccucagcuccgggcaccugaaaugccggcuuaagauggauaaacugagacucaagggaguuagcuauucucuguguacagccgcuuucaccuuuacaaaaaucccggccgaaaccguggacggcacggucaccguggaggggcaguacggaggcacagacgggccuugcaagguucccgcgcaaauggccguggauaugcagacccugacaccugucggccgccucauuaccgcuaaccccgugaucacggaauccacagagaauagcaagaugaugcuggagcuugaucccccuuucggagacucuuacaucgugauuggcguuggggagaaaaagaucacccaucacuggcaccgguccggaagcacaauuggcaaagccuuugaagcuaccgucagaggggccaagcgcauggccgugcugggagacaccgcuugggauuucggcuccgucgggggcgcgcucaacucucugggaaaaggcauccaucagauuaucggggccgcuuucaagagccuguuuggaggcauguccugguucucucaaauccuuauugggacacuccugauguggcugggacucaauacgaagaacggcagcaucucccugaugugucuugcccucgggggcgugcugauuuuucugagcaccgccgugucuggaggcguugggugcuccguggacuucagcaaa

SEQ ID NO: 2340 - RNA, 2136 nt, Artificial Sequence
  KY328290.1 prME-long CDS opt
agaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuagcaaaauuccggccgaaacccugcauggcacggugaccgaggaaguucaguacgcugggacagacggaccuugcaaggugcccgcccaaauggcugucgauaugcagacccugacaccugugggccgccucaucaccgccaaccccgugaucacggagucuacagagaacuccaagaugaugcuggaacuugaucccccuuucggggacagcuacauuguuaucggcgucggagagaaaaagauuacccaccacuggcaucgguccggcucuacaaucgggaaagcguuugaagccaccgugagaggagcuaagcgcauggccgugcugggcgacaccgcuugggauuucgggagcgucggaggcgcccucaauucccuggggaaaggcauucaccagaucuucggagccgcuuuuaagucucuguucggcgggaugagcugguuuucccaaauccuuauuggaacacuccugauguggcugggccucaacacgaagaaugggagcaucucucugaugugucuugcgcugggaggcgugcucauuuuccuguccaccgccguuagcgcugacguggggugcucugucgauuuuuccaaa

SEQ ID NO: 2341 - RNA, 2136 nt, Artificial Sequence
  KX694532.2 prME-long CDS opt
agaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugaugugucuugcgcugggaggcguucucauuuuccugucuacagccguguccgcugacgucgggugcagcguggauuuuucuaaa

SEQ ID NO: 2342 - RNA, 2136 nt, Artificial Sequence
  KU955593.1 prME-long CDS opt
agaaucauuaacgcccggaaggagaaaaagcgcagaggcaccgacacaagcguggggaucgucggacugcuccugacgaccgcuauggccguugaagugacacggcgcggcaaugcguacuauauguaccuugauagauccgacgcuggggaggccauuucuuuccccaccacaaugggaaugaacaaaugcuauauccagauuauggaucugggccacaugugugacgccaccaugagcuacgaaugcccuaugcucgaugaggggguggaaccggacgaugucgacuguuggugcaauacaaccuccacgugggugguuuauggaaccugucaucacaagaaaggcgaggcucggcgcucuagacgggccgugacacugcccagccauuccacccgcaaacuucaaacaagaucucagaccuggcuggagagccgggaauacacgaagcaccucauccgcgucgagaacuggaucuuuagaaauccuggcuucgcucuggccgcggccgcuauugccuggcugcucggguccagcacaucucagaaagugaucuaucugguuaugauucuucugaucgcucccgccuacuccauucggugcaucggagugagcaaccgcgauuuugucgaaggcaugucugggggaaccuggguggacgugguccucgagcauggcggguguguuacagugauggcgcaggauaagccuaccguggacauugagcuggucaccacaacgguguccaauauggccgaaguuagaagcuacugcuaugaggcuucuaucuccgauauggccagcgacucccggugucccacccaaggagaggcuuaccuugacaaacagucugauacacaguaugugugcaagagaacccuggucgaccgcggcuggggcaacggguguggacucuucggcaaagggagccuggugacaugcgccaaguuugccugcuccaagaaaaugaccggaaagagcauccagccugaaaaucuggaauaccggauuaugcucucuguucacggcucccaacacagcgggaugaucgugaacgauacgggacaugagacagacgagaauagagcuaaagucgaaauuaccccgaacucuccccgcgcggaggccacccugggcggcuucgggagccuuggacuggauugugaaccucggacaggccucgacuuuuccgaucuguauuaccuuaccaugaauaacaagcacuggcuggugcauaaagagugguuccacgacaucccccucccuuggcacgcuggggccgauacaggaacgccccauuggaauaacaaggaagcccuggucgaguuuaaagacgcucacgccaagagacagaccgugguugugcugggcucucaggagggggcgguccauacagcucucgccggcgcccuggaagcugagauggauggagccaagggccgccuuagcuccgggcaccugaaaugccggcucaagauggacaaacugagacuuaagggagugagcuauucucuguguaccgcugccuucacauuuaccaaaauuccggcggaaacgcuccauggcaccguuacaguggagguccaguacgccgggaccgacggaccuugcaaggugcccgcucaaauggccguggauaugcagacacugaccccuguuggccgccugaucacggcuaaccccgucaucacagaauccaccgagaauagcaagaugaugcucgagcuggaucccccuuucggggacucuuacauugugaucggcgugggagaaaagaagauuacacaccacuggcaucgguccggcagcaccaucgggaaagccuuugaggcgaccgucagaggagccaagcgcauggcugugcuuggcgacacagccugggauuucggguccguuggaggcgcucugaacucucucgggaaaggcauucaccagaucuucggagccgccuuuaagagccuguucggcgggauguccugguuuucucaaauccugauuggaacgcuucucguguggcugggccugaauaccaagaacgggagcaucucccucaugugucuggcucuuggaggcguccugauuuuccucagcacagcggugucugccgacguugggugcuccguggauuuuagcaaa

SEQ ID NO: 2343 - RNA, 2136 nt, Artificial Sequence
  KY272987.1 prME-long CDS opt
agaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugguuugucuugcgcugggaggcgugcucauuuuccugucuacagccgucuccgcugacguggggugcagcguugauuuuucuaaa

SEQ ID NO: 2344 - RNA, 2136 nt, Artificial Sequence
  EU545988.1 prME-long CDS opt
agaaucauuaacgcccggaaggagaaaaagcgcagaggcaccgacacaagcguggggaucgucggacugcuccugacgaccgcuauggccguugaagugacacggcgcggcuccgcguacuauauguaccuugauagaucugacgcuggggaggccauuagcuuccccaccacacugggaaugaauaaaugcuauauccagauuauggaucucggccacaugugugacgccaccauguccuacgaaugcccuaugcuggaugaggggguggaaccggacgaugucgacuguuggugcaacacaaccucuacgugggugguuuauggaaccugucaucacaagaaaggcgaggcucggcgcagcagacgggccgugacacuucccucccauucuacccgcaagcugcaaacaagaagccagaccuggcucgagucccgggaauacacgaagcaccugauccgcgucgagaauuggaucuuuagaaacccuggcuucgcucuggccgcggccgcuauugccuggcuccuggggagcucuacaucccagaaagugaucuaucuuguuaugauucugcucaucgcucccgccuacagcauucggugcaucggagugucuaaucgcgauuuugucgaaggcauguccgggggaaccuggguggacgugguccuggagcauggcggguguguuacagugauggcgcaggauaagccugccguggacauugagcuugucaccaccacagugagcaacauggcugaaguuagaucuuacugcuaugaggccuccaucagcgauauggcuuccgacucucggugucccacgcaaggagaagccuaccuggacaaacagagcgauacccaguaugugugcaagagaacacucgucgaccgcggcuggggcaauggguguggacuguucggcaaagggucccuggugaccugcgccaaguuugcuugcagcaagaaaaugacaggaaagucuauccagccugagaaccucgaauaccggauuaugcuguccguucacggcagccaacacucugggaugaucgugaaugauaccggacaugagacggacgagaacagagcgaaagucgaaauuacaccgaauagcccccgcgccgaggcuacccuuggcggcuucgggucccugggacucgauugugaaccucggaccggccuggacuuuucugaucuuuauuaccugacaaugaacaauaagcacuggcucgugcauaaagagugguuccacgacaucccccugccuuggcacgccggggccgauaccggaacaccccauuggaacaauaaggaagcucuggucgaguuuaaagacgcccacgcgaagagacagacggugguugugcucggcagccaggagggggcuguccauaccgcccuggccggcgcucuugaagccgagauggauggagcuaagggccgccuguccagcgggcaccucaaaugccggcugaagauggacaaacuuagacugaagggagugucuuauucccucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaaagcacagagaacucuaagaugaugcuggagcuugaucccccuuucggggacuccuacauugugaucggcgugggagagaaaaagauuacccaccacuggcaucggagcggcuccacaaucgggaaagcguuugaagccaccgucagaggagcuaagcgcauggccgugcugggcgacaccgcuugggauuucgggucuguuggaggcgcccucaauagccuggggaaaggcauucaccagaucuucggagccgcuuuuaagucccuguucggcgggaugucuugguuuagccaaauccuuauuggaacacuccugguguggcugggccucaacacgaagaauggguccaucagccugaccugucuugcgcugggaggcguccucauuuuccugucuacagccguguccgcugacguugggugcagcguggauuuuucuaaa

SEQ ID NO: 2345 - RNA, 2136 nt, Artificial Sequence
  KU681082.3 prME-long CDS opt
agaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggaaugaauaaaugcuauauccagauuauggaucucggccacaugugugacgcuacaauguccuacgaaugcccuaugcuggaugaggggguggaaccggacgaugucgacuguuggugcaacaccacaucuaccugggugguuuauggaacgugucaucacaagaaaggcgaggcccggcgcagcagacgggcugugacccuucccucccauucuacacgcaagcugcaaaccagaagccagacauggcucgagucccgggaauacaccaagcaccugauccgcgucgagaauuggaucuuuagaaacccuggcuucgcccuggcggccgcugugauugccuggcuccuggggagcucuacgucccagaaaguuaucuaucuugugaugauucugcucaucgcucccgccuacagcauucggugcaucggagucucuaaucgcgauuuuguggaaggcauguccgggggaacauggguggacgucguucuggagcauggcgggugugugaccgugauggcgcaggauaagccuacagucgacauugagcuugugaccaccacaguuagcaacauggccgaagugagaucuuacugcuaugaggcuuccaucagcgauauggccuccgacucucggugucccacgcaaggagaggcuuaccuggacaaacagagcgauacccaguaugucugcaagagaacacucguggaccgcggcuggggcaauggguguggacuguucggcaaagggucccugguuaccugcgccaaguuugccugcagcaagaaaaugacaggaaagucuauccagccugaaaaccucgaauaccggauuaugcuguccgugcacggcagccaacacucugggaugaucgucaaugauaccggacaugagacggacgagaacagagcuaaaguggaaauuacaccgaauagcccccgcgcggaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgcuggggccgauaccggaacaccccauuggaacaauaaggaagcccugguggaguuuaaagacgcucacgccaagagacagacgguugugguccucggcagccaggagggggcggugcauaccgcucuggccggcgcccuugaagcugagauggauggagccaagggccgccuguccagcgggcaccucaaaugccggcugaagauggacaaacuuagacugaagggaguuucuuauucccucuguacagcugccuucaccuuuacaaaaauuccggcggaaacccugcauggcacggugaccgucgaggugcaguacgccgggacagacggaccuugcaaggugcccgcucaaauggccguugauaugcagacccugacaccugucggccgccucaucaccgcuaaccccgugaucacggaaagcacagagaacucuaagaugaugcuggagcuugaucccccuuucggggacuccuacauugugaucggcgucggagagaaaaagauuacccaccacuggcaucggagcggcuccacaaucgggaaagccuuugaagcgaccgugagaggagccaagcgcauggcuguucugggcgacaccgccugggauuucgggucugugggaggcgcucucaauagccuggggaaaggcauucaccagaucuucggagccgccuuuaagucccuguucggcgggaugucuugguuuagccaaauccuuauuggaacacuccuggucuggcugggccucaacacgaagaauggguccaucagccugaccugucuugcucugggaggcgugcucauuuuccugucuacagcgguuuccgccgacguggggugcagcgucgauuuuucuaaa

SEQ ID NO: 2346 - RNA, 2136 nt, Artificial Sequence
  KX601167.1 prME-long CDS opt
agaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggagugaauaaaugcuauauccagauuauggaucucggccacaugugugacgcuacaauguccuacgaaugcccuaugcuggaugagggggucgaaccggacgauguggacuguuggugcaacaccacaucuaccuggguuguguauggaacgugucaucacaagaaaggcgaggcccggcgcagcagacgggcugucacccuucccucccauucuacacgcaagcugcaaaccagaagccagacauggcucgagucccgggaauacaccaagcaccugauccgcguggagaauuggaucuuuagaaacccuggcuucgcccuggcggccgcugccauugcuuggcuccuggggagcucuacgucccagaaaguuaucuaucuugugaugauucugcucaucgcccccgcguacagcauucggugcaucggagucucuaaucgcgauuuuguggaaggcauguccgggggaacauggguggacgucguucuggagcauggcgggugugugaccgugauggcccaggauaagccuacagucgacauugagcuugugaccaccacaguuagcaacauggcugaagugagaucuuacugcuaugaggccuccaucagcgauauggcuuccgacucucggugucccacgcaaggagaagccuaccuggacaaacagagcgauacccaguaugucugcaagagaacacucguggaccgcggcuggggcaauggguguggacuguucggcaaagggucccugguuaccugcgccaaguuugcuugcagcaagaaaaugacaggaaagucuauccagccugagaaccucgaauaccggauuaugcuguccgugcacggcagccaacacucugggaugaucgucaaugauaccggacaugagacggacgagaacagagcgaaaguggaaauuacaccgaauagcccccgcgccgaggcuacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggccgauaccggaacaccccauuggaacaauaaggaagcucugguggaguuuaaagacgcccacgcgaagagacagacgguugugguccucggcagccaggagggggcugugcauaccgcccuggccggcgcucuugaagccgagauggauggagcuaagggccgccuguccagcgggcaccucaaaugccggcugaagauggacaaacuuagacugaagggaguuucuuauucccucuguacagccgcguucaccuuuacaaaaauuccggccgaaacccugcauggcacggugaccgucgaggugcaguacgcugggacagacggaccuugcaaggugcccgcccaaauggcuguugauaugcagacccugacaccugucggccgccucaucaccgccaaccccgugaucacggaaagcacagagaacucuaagaugaugcuggagcuugaucccccuuucggggacuccuacauugugaucggcgucggagacaaaaagauuacccaccacugguaucggagcggcuccacaaucgggaaagcguuugaagccaccgugagaggagcuaagcgcauggccguucugggcgauaccgcuugggacuucgggucugugggaggcgcccucaauagccuggggaaaggcauucaucagaucuucggagccgcuuuuaagucccuguucggcgggaugucuugguuuagccaaauccuuauuggaacacuccuggucuggcugggccucaacacgaagaauggguccaucagccugaccugucuugcgcugggaggcgugcucauuuuccugucuacagccguuuccgcugauguggggugcagcgucgacuuuucuaaa

SEQ ID NO: 2347 - RNA, 2136 nt, Artificial Sequence
  KX694533.2 prME-long CDS opt
agaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccgggaaagccauuagcuuccccacaacccugggagugaauaagugcuauauccagauuauggaucucggccacaugugugacgcuacaauguccuacgagugcccuaugcuggaugaaggggucgagccggacgauguggacuguuggugcaacaccacaucuaccuggguuguguauggaacgugucaucacaaaaagggcgaagcccggcgcagcagacgggcugucacccuucccucccauucuacacgcaagcugcaaaccagaagccagacauggcucgagucccgggaguacaccaaacaccugauccgcguggaaaauuggaucuuuagaaacccuggcuucgcccuggcggccgcugccauugcuuggcuccuggggagcucuacgucccagaagguuaucuaucuugugaugauucugcucaucgcccccgcguacagcauucggugcaucggagucucuaaucgcgauuuuguggagggcauguccgggggaacauggguggacgucguucuggaacauggcgggugugugaccgugauggcccaggauaaaccuacagucgacauugagcuugugaccaccacaguuagcaacauggcugaggugagaucuuacugcuaugaagccuccaucagcgauauggcuuccgacucucggugucccacgcaaggagaggccuaccuggacaagcagagcgauacccaguaugucugcaaaagaacacucguggaccgcggcuggggcaauggguguggacuguucggcaaggggucccugguuaccugcgccaaguuugcuugcagcaaaaagaugacaggaaaaucuauccagccugaaaaccucgaguaccggauuaugcuguccgugcacggcagccaacacucugggaugaucgucaaugauauuggacaugaaaccgacgagaacagagcgaagguggagaucacgccgaauagcccccgcgccgaagcuacacuuggcggcuucgggucccugggacucgauugugagccucggaccggccuggacuuuucugaucuuuauuaccugaccaugaacaauaaacacuggcucguccauaaggaaugguuccacgacauuccccugccuuggcacgccggggccgauacaggaacaccccauuggaacaauaaagaggcucugguggaauuuaaggacgcccacgcgaagagacagacaguugugguccucggcagccaggagggggcugugcauacggcccuggccggcgcucuugaggccgaaauggauggagcuaaaggccgccuguccagcgggcaccucaagugccggcugaaaauggacaaacuuagacugaagggaguuucuuauucccucuguaccgccgcguucacauuuaccaagaucccggccgagacacugcauggcaccgugacggucgaagugcaguacgcugggaccgacggaccuugcaaggugcccgcccaaauggcuguugauaugcagacacugaccccugucggccgccucaucacagccaaccccgugauuaccgagagcacggaaaacucuaaaaugaugcuggagcuugaucccccuuucggggacuccuacaucgugauuggcgucggagacaagaaaaucacacaccacuggcaucggagcggcuccaccauugggaaggcguuugaggccacagugagaggagcuaaacgcauggccguucugggcgauaccgcuugggacuucgggucugugggaggcgcccucaauagccuggggaagggcauccaccagaucuucggagccgcuuuuaagucccuguucggcgggaugucuugguuuagccaaauucuuaucggaacccuccuggucuggcugggccucaacaccaaaaauggguccauuagccugacgugucuugcgcugggaggcgugcucaucuuccugucuaccgccguuuccgcugauguggggugcagcgucgacuuuucuaag

SEQ ID NO: 2348 - RNA, 2136 nt, Artificial Sequence
  KY288905.1 prME-long CDS opt
agaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugauacaggacacgaaaccgacgagaacagagccaagguggaggucaccccuaauagcccgcgcgcugaagcgacacuuggcggcuucgggucccugggacucgauugugagccccggaccggccuggacuuuucugaucuuuacuaucugacaaugaacaauaaacauuggcucgugcacaaggaaugguuccacgacaucccucugcccuggcaugccggggcugauacgggaaccccucacuggaacaauaaagaggcccugguugaauuuaaggacgcccaugcuaagagacagacaguggucgugcucggcagccaggagggggccguucacaccgcgcuggcuggcgcccuugaggccgaaauggauggagcuaaaggccgccuguucuccgggcaucucaagugccggcugaaaauggacaaacuuagacugaaaggagugagcuacucucucuguacagccgcuuuuaccuucacgaagguccccgccgagacccugcacggcacagugaccguggaaguucaguaugcggggacagacggaccgugcaaggucccugcccaaauggcuguggauaugcagacccugacgcccgugggccgccucauuacagccaacccugucaucaccgaguccacagaaaacagcaaaaugaugcuggagcuugacccucccuuuggggauucuuacaucgugauuggcguuggagacaagaaaaucacccaccauuggcaccgguccggcagcaccauugggaaggcuuucgaggccacagugagaggagcgaaacgcauggccguccugggcgauacggcuugggacuucggguccgugggaggcguuuuuaauucucucgggaagggcauccaucagauuuucggagccgcuuuuaagagccuguucggcgggauguccugguuuucucaaauccugaucggaacccuucucguguggcugggccugaacacaaagaaugggagcauuucccucaccugucuggcccuuggaggcgucaugaucuuccugagcacagccgugucugcugauguugggugcuccguggacuuuagcaag

SEQ ID NO: 2349 - RNA, 2136 nt, Artificial Sequence
  KF268950.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgauauuggacacgaaaccgacgagaauagagcgaagguggaggucacgccuaacagcccgcgcgccgaagcuacacuuggcggcuucgggucccugggacucgauugugagccccggaccggccuggacuuuucugaucuuuacuaucugaccaugaauaacaaacauuggcucgugcacaaggaaugguuccacgacaucccucugcccuggcaugccggggccgauacaggaaccccucacuggaauaacaaagaggcucuggucgaauuuaaggacgcccaugcgaagagacagacagugguugugcucggcagccaggagggggcuguccacacggcccuggccggcgcucuugaggccgaaauggauggagcuaaaggccgccuguucuccgggcaucucaagugccggcugaaaauggacaaacuuagacugaaaggagugagcuacucucucuguaccgccgcguuuacauucaccaagguucccgccgagacacugcacggcaccgugacggucgaagugcaguaugcugggaccgacggaccgugcaaggugccugcccaaauggcuguugauaugcagacacugacccccgucggccgccucaucacagccaacccugugauuaccgaguccacggaaaauagcaaaaugaugcuggagcuugacccucccuuuggggauucuuacaucgugauuggcgucggagacaagaaaaucacacaccauuggcaccgguccggcagcaccauugggaaggcguucgaggccacagugagaggagcuaaacgcauggccguucugggcgauaccgcuugggacuucggguccgugggaggcgucuuuaacucucucgggaagggcgugcaucagaucuucggagccgccuuuaagagccuguucggcgggauguccugguuuucucaaauccugauuggaacccuucucguuuggcugggccugaauacaaagaacgggagcaucucccucacgugucuggcucuuggaggcgugaugauuuuccugagcaccgcggucucugccgauguggggugcuccguugacuuuagcaag

SEQ ID NO: 2350 - RNA, 2136 nt, Artificial Sequence
  KF383121.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauauuggacacgaaacggacgagaacagagcuaaggucgaggugacaccuaauagcccgcgcgcggaagccacccuuggcggcuucgggucccugggacucgauugugagccccggaccggccuggacuuuucugaucuuuacuaucugacaaugaacaauaaacauuggcucguccacaaggaaugguuccacgacaucccucugcccuggcaugcuggggccgauaccggaacaccucacuggaacaauaaagaggcccugguggaauuuaaggacgcucaugccaagagacagacgguugugguccucggcagccaggagggggcggugcacaccgcucuggccggcgcccuugaggcugaaauggauggagccaaaggccgccuguucuccgggcaucucaagugccggcugaaaauggacaaacuuagacugaagggaguuagcuacucucucuguacagcugccuuuaccuucacaaaggugcccgcggagacccugcacggcacggucaccguggaagugcaguaugccgggacagacggaccgugcaagguuccugcucaaauggccgucgauaugcagacccugacacccgugggccgccucaucaccgcuaacccugugauuacggaguccacagaaaacagcaaaaugaugcuggagcuugacccucccuuuggggauucuuacaucgucauuggcgugggagacaagaaaaucacccaccauuggcaccgguccggcagcacaauugggaaggccuucgaggcgaccguuagaggagccaaacgcauggcugugcugggcgauaccgccugggacuucggguccgucggaggcguguuuaauucucucgggaagggcauccaucagaucuucggagcugccuuuaagagccuguucggcgggauguccugguuuucucaaauucugaucggaacacuucucguuuggcugggccugaacacgaaaaaugggagcauuucccucaccugucuggcccuuggaggcgugaugaucuuccugagcacagcugucucugcggauguggggugcuccguugacuuuagcaag

SEQ ID NO: 2351 - RNA, 2118 nt, Artificial Sequence
  KF268949.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgaugaaaauagagcgaagguggaggucaccccuaacagcccgcgcgccgaggcuacgcuuggaggcuucggcucccuggggcucgacugugaaccccggacaggacuggauuuuucugaccuuuacuaucugaccaugaauaacaaacacuggcucgugcauaaggagugguuccacgauauuccucugcccuggcacgccggcgccgacaccgggacaccucauuggaauaacaaagaagcucuggucgaguuuaaggaugcccacgcgaagagacagaccgugguugugcucggaagccaggaaggcgcuguccauacagcccuggccggggcucuugaggccgagauggacggcgcuaaaggacgccuguucuccggccaccucaagugccggcugaaaauggauaaacuuagacugaagggggugagcuacucucucuguacggccgcguuuaccuucacaaagguucccgccgaaacccugcauggaacagugaccgucgaggugcaguaugcuggcacggacgggccgugcaaggugccugcccaaauggcuguugacaugcagacccugacacccgucggacgccucaucaccgccaacccugugaucacagaauccaccgagaauagcaaaaugaugcuggaacuugauccucccuuuggcgacucuuacauugugaucggggucggcgauaagaaaauuacgcaccacuggcaucgguccggaagcacaaucggcaaggcguucgaggccaccgugagaggggcuaaacgcauggccguucugggagacacagcuugggauuucggcuccgucgggggaguguuuaacucucucggcaaggggauucaccagaucuucggcgccgccuuuaagagccuguucggaggcauguccugguuuucucaaauccugauugggacccuucucguguggcugggacugaauaccaaaaacggcagcaucucccucacaugucuggcucuugggggaguuaugauuuuccugagcacggcggugucugccgacgucggcugcuccguggauuuuagcaag

SEQ ID NO: 2352 - RNA, 2136 nt, Artificial Sequence
  KU955595.1 prME-long CDS opt
agaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugauacgggacacgaaacagacgagaacagagcuaagguggaggucaccccuaauagcccgcgcgcggaagccacccuuggcggcuucgggucccugggacucgauugugagccccggacaggccuggacuuuucugaucuuuacuaucugaccaugaacaauaaacauuggcucgugcacaaggaaugguuccacgacaucccucugcccuggcaugcuggggccgauacaggaacgccucacuggaacaauaaagaggcccugguugaauuuaaggacgcucaugccaagagacagaccguggucgugcucggcagccaggagggggcgguucacacagcucuggccggcgcccuugaggcugaaauggauggagccaaaggccgccuguucuccgggcaucucaagugccggcugaaaauggacaaacuuagacugaagggagugagcuacucucucuguaccgcugccuuuacauucaccaagguccccgcggagacgcugcacggcaccgugacaguggaaguucaguaugccgggaccgacggaccgugcaaggucccugcucaaauggccguggauaugcagacacugacccccgugggccgccucauuacggcuaacccugucaucacagaguccaccgaaaacagcaaaaugaugcuggagcuugacccucccuuuggggauucuuacaucgugauuggcguuggagacaagaaaaucacacaccauuggcaccgguccggcagcaccauugggaaggccuucgaggcgaccgugagaggagccaaacgcauggcuguccugggcgauacagccugggacuucggguccgugggaggcguuuuuaauucucucgggaagggcauccaucagauuuucggagcugccuuuaagagccuguucggcgggauguccugguuuucucaaauccugaucggaacgcuucucguguggcugggccugaacaccaaaaaugggagcauuucccucacaugucuggcccuuggaggcgucaugaucuuccugagcaccgcugugucugcggauguugggugcuccguggacuuuagcaag

SEQ ID NO: 2353 - RNA, 2136 nt, Artificial Sequence
  KF383116.1 prME-long CDS opt
agaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaacacaagaaaggcgaagcccgcagaagccggcgcgcgguuacccuuccgucccauucuacaagaaagcugcagacccggagccagacauggcucgagucccgcgaguauaccaagcaccugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacauggcgggugugugaccgugauggcccaagauaaacccacagucgacaucgagcuugugaccaccacaguuagcaacauggcugaggugagaucuuacugcuacgaagccuccaucagcgauauggcuuccgacucucgguguccuacgcagggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucaacccgaaaaccucgaguaucggaucaugcuguccgugcacggcagccagcacucugggaugauugucaaugauaucggacaugaaacggacgagaacagagcuaagguggaggucacaccuaauagcccgcgcgcggaagccacccuuggcggcuucgggucccugggacucgauugugagccccggaccggccuggacuuuucugaucuuuacuaucugacaaugaacaauaaacacuggcucgugcauaaggaaugguuccacgacauuccucugcccuggcacgcuggggccgauaccggaacaccucauuggaacaauaaagaggcccugguugaauuuaaggacgcucacgccaagagacagacgguggucgugcucggcagccaggagggggcgguucauaccgcucuggccggcgcccuugaggcugaaauggauggagccaaaggccgccuguucuccgggcaccucaagugccggcugaaaauggacaaacuuagacugaaaggagugagcuacucucucuguacagcugucugcaccgccgcgaaggugcccgccgagacacugcauggcaccgugacgguugaaguccaauaugcugggaccgacggaccguguaaggugccugcccagauggcuguggauaugcagacacugacccccgucggccgccucaucacagccaacccugugaucaccgaguccacggaaaacagcaaaaugaugcuggagcuugacccucccuuuggggauucuuacauuguuaucggcgugggagacaagaaaauuacacaccacuggcaucgguccggcagcaccaucgggaaggcguucgaggccacagucagaggagcuaaacgcauggccgugcugggcgauaccgcuugggacuuuggguccguuggaggcguguucaauucucucgggaagggcauucaccaaaucuucggagccgccuuuaagagccuguucggcgggauguccugguuuucucagauccugauuggaacccuucucgucuggcugggccugaacacaaagaaugggagcaucucccucacgugccuggcucuuggaggcgugaugauuuuccugagcaccgcgguuucugccgaugugggguguuccgucgacuuuagcaag

SEQ ID NO: 2354 - RNA, 2118 nt, Artificial Sequence
  KU963574.2 prME-long CDS opt
agaaucauuaacgcccggaaggagcgcaaaagacggggcgcugacgccagcaucgggauugugucccugcuccugaccacagucauggcggcugaaaucacgcgcagaggaucugccuacuauauguaccuugaucggagcgacgccggcaaggcuauuuccuucguuaccacacugggggugaauaaaugccacgugcagaucauggaucucggacauaugugugacgccaccaugucuuaugagugccccaugcuggaugaaggcgucgagcccgacgauguggacuguuggugcaacacaaccagcacauggguuguguacgggaccugucaccauaagaaaggagaagcucgcagaucccggcgcgccgucacgcuuccgucucacagcaccagaaagcugcaaacacggucccagaccuggcucgagagccgcgaguauacaaagcaucugaucaaaguggaaaauuggauuuuuagaaaccccggcuucgcgcugguugccguggcuaucgccuggcuccugggaucuuccaccagccagaaggucauuuaccuugugaugauccugcucauugcuccugccuauucuauccggugcauugggguguccaaucgcgauuuugucgagggaaugagcggcgggacguggguugacguggugcuggaacacggaggcugugucacagugauggcgcaggauaaacccaccguugacaucgagcuugugacaaccaccgucucuaacauggccgaggugagauccuacugcuacgaagcuagcaucuccgauauggccucugacagccgguguccuacacaaggggaggcuuaucuggacaagcaguccgauacgcaguacguuugcaaaagaacccucguggaccgcggauggggcaauggcugugggcuguucggaaagggcagccuggucacaugcgccaaguuuaccugcucuaaaaagaugacagggaaauccauucagcccgaaaaccucgaguaucggaucaugcugagcgugcacggaucucaacauagcggcaugauugucaaugaugaaaacagagccaagguggagguuaccccuaauuccccgcgcgcugaggcgacgcuugggggauucggcucucugggccucgacugugaaccccggacagggcuggauuuuagcgaccuuuacuaucugaccaugaacaauaaacacuggcucgugcauaaggagugguuccacgauaucccucugcccuggcacuccggagccgacaccgaaacaccucauuggaacaauaaagaggcucuggucgaauuuaaggaugcccacgccaagagacagaccgugguugugcucggcagccaggagggggcuguccauacagcccuggcgggagcucuugaggccgaaauggacggcgccaaagggcgccugucuuccggccaccucaagugccggcugaaaauggauaaacuuagacugaaaggagugagcuacucucucuguacggcugccuucaccuuuacaaaggugcccgcugagacccugcauggcacaguuaccgucgaagugcaguaugccgggcgcgacggaccgugcaaggugccugcgcaaauggccgucgacaugcagacgcugacccccgugggccggcucauuacagcuaacccuguuaucaccgaguccacagaaaacagcaaaaugaugcuggagcuugauccucccuucggggacuccuacaucgugauuggagucggcgauaagaaaaucacccaccacuggcauagaucugggagcauuaucggcaaggccuuugaggcuacggugcgcggagccaaacggauggcgguucugggcgacacagccugggauuucggguccgugggaggcgucuucaauucucucgggaagggcauucaccagaucuuuggcgcugccuucaagagccuguuugggggcauguccugguucagccaaauccugauuggaacccuucucguguggcugggccugaacacaaagaaugggucuaucucccucaccugucuggcucuuggaggcguuaugauuuuucugagcaccgccgugucugccgacgucgggugcuccguggauuucagcaag

SEQ ID NO: 2355 - RNA, 2118 nt, Artificial Sequence
  KX601166.1 prME-long CDS opt
agaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugaugaaaacagagcuaagguggaggucacgccuaauagcccgcgcgcggaggccacacuuggaggcuucggcucccuggggcucgacugugaaccccggaccggacuggauuuuucugaccuuuacuaucugaccaugaacaauaaacacuggcucgugcauaaggagugguuccacgauaucccucugcccuggcacgcuggcgccgacacagggaccccucauuggaacaauaaagaagcccugguugaguuuaaggaugcucacgccaagagacagacaguggucgugcucggaagccaggaaggcgcgguucauacggcucuggccggggcccuugaggcugagauggacggcgccaaaggacgccuguucuccggccaccucaagugccggcugaaaauggauaaacuuagacugaaaggggugagcuacucucucuguaccgcugccuuuacauucaccaagguccccgcggaaacacugcauggaaccgugacgguggagguucaguaugccggcaccgacgggccgugcaaggucccugcucaaauggccguggacaugcagacacugacccccgugggacgccucauuacagcuaacccugucaucaccgaauccacggagaacagcaaaaugaugcuggaacuugauccucccuuuggcgacucuuacaucgugauugggguuggcgauaagaaaaucacacaccacuggcaucgguccggaagcaccauuggcaaggccuucgaggcgacagugagaggggccaaacgcauggcuguccugggagacaccgccugggauuucggcuccguugggggaguguuuaauucucucggcaaggggauccaccagauuuucggcgcugccuuuaagagccuguucggaggcauguccugguuuucucaaauccugaucgggacccuucucguguggcugggacugaacacaaagaauggcagcauuucccucacgugucuggcccuugggggagucaugaucuuccugagcaccgcugugucugcggacguuggcugcuccguggauuuuagcaag

SEQ ID NO: 2356 - RNA, 2136 nt, Artificial Sequence
  KF383118.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagccugacgauguggacuguuggugcaacaccacaucuaccuggguggucuacggaacgugucaccauaagaaaggcgaaacccgcagaagccggcgcuccgugucucuuagauaucacuacacacggaagcugcaaacccgcagccagacauggcucgaguccagagaguauaagaaacaucugauuaugguugaaaauuggaucuuucggaacccgggcuucgccauugugagcgucgcgaucaccuggcugauggggucucucacgucccagaaggugauuuaccugguuaugaucgugcuuauuguccccgccuacagcaucucuugcaucggaguguccaaucgcgaucugguggagggcaugagcgggggaacaugggucgacguugugcucgaacacggcgggugugugaccgagauggcucaggauaaaccuacagucgacauugagcuggugaccaugaccguuucuaacauggccgaagugagauccuauugcuacgaggcuagccuuuccgauauggccucugcgagccggugucccacacaaggagaaccuucccuggacaagcagagcgacacgcagucugucugcaaaagaacccucggcgaucgcggcugggggaauggauguggcaucuuugggaagggaucccuggugacaugcagcaaguuuaccugcuguaaaaagaugcccggcaaaucuauucagccugagaaccuggaauaucggaucaugcucccgguucacgggagccaacauuccggaaugauugugaaugacaucggccacgagacagaugagaacagagccaaggucgaagugacccccaauucuccucgcgcugaggccacgcugggcggguuuggaagccuuggccuggacugcgaaccccggacagggcucgauuucuccgaccuguacuaucuuaccaugaacaauaaacauuggcugguccacaaggagugguuucacgauaucccucuccccuggcaugcuggagccgacaccggcacaccgcacuggaacaauaaagaagcccugguggaguucaaggaugcucaugcgaagagacagaccguugugguccuggggagccaggagggcgccgugcacacagcucucgccggagcccuggaagcugagauggacggcgccaaagggcgccuuuucucuggacaucugaagugucggcucaaaauggauaagcugagacuuaaaggcguuuccuacagccugugcacggcggcuuucaccuuuacaaaggugccugccgaaacccuccacgggacagucaccguggaggugcagucugccggaacggacggccccuguaagguuccugcucaaauggccgucgacaugcagacccugacacccguggggcgccugauuaccgcuaaccccgugaucacagaauccaccgagaacagcaaaaugaugcucgagcuggauccuccguucggcgacuccuauauugucaucggagugggcgauaagaaaauuacgcaccauuggcaccggucugggagcacaaucggaaaggccuuugaagcgaccguuagaggcgccaaacgcauggcugugcuuggggacacagccugggauuucggauccgucggcgggguguucaauucucugggcaagggaauccaucagauuuuuggcgcugccuucaagagccucuuugggggaauguccugguucagccaaauccugauuggcacccugcuuguuuggcucgggcugaacaccaaaaauggaucuaucucccugacaugccucgcgcugggcggggugaugauuuuucuuagcacggccgucucugcugacgugggcuguuccguugauuucagcaag

SEQ ID NO: 2357 - RNA, 2130 nt, Artificial Sequence
  KF383120.1 prME-long CDS opt
agaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaccaugggagugaauaaaugccacguccagaucauggaucugggccauaugugugacgcuacaauguccuaugagugccccaugcucgaugaagggguugagccugacgauguggacuguuggugcaacaccacaucuaccuggguggucuacggaacgugucaccauaagaaaggcgaagcccgcccgagcagacgggcggugacccugcccucccacucuacacgcaaacuucaaaccagaagccagacauggcuggagucccgggaguauaccaagcaucucauuaagguugaaaauuggauccugcgcaacccuggcuuuacgguggccgcucuggccauggcuuggcuccuggggaauagcacaucucagagagucauuuaccuugugaugauccugcucauugcccccgcguauuccauccggugcauuggaguuagcaaccgcgauuucguggagggcaugucugggggaaccugggucgacguggugcuggaacacggcgggugugucacaguuauggcccaggauaagccuaccguggacaucgagcuugugaccacaacggucuccaauauggcugaggugagaagcuacugcuacgaagccucuaucuccgauauggcuagcgacucccggugucccacccaaggagaggccuaucuggacaaacagucugauacacaguacguuugcaagagaacccucguggaccgcggcuggggcaacggguguggacuguuuggcaaagggagccuggucacaugcgccaaguuuaccugcuccaagaaaaugacgggaaagagcauucagccugaaaaucucgaguaucggaucaugcugucugugcacggcucccaacauagcgggaugauuguuaacgauaucggacacgaaacagacgagaauagagcuaaaguggaggucaccccgaacucuccccgcgcggaagccacccuuggcggcuucgggagccugggacucgauugugagccucggacaggccuggacuucuccgaucuuuacuaucugaccaugaauaacaagcauuggcucgugcacaaagaaugguuucacgacauuccccugccuuggcaugcuggggccgauacaggaacgccccacuggaauaacaaggaggcccuggucgaguucaaagacgcucaugccaagagacagaccgugguugugcucggcucucaggaaggggcgguccacacagcucuggccggcgcccuugaggcugaaauggauggagccaagggccgccuguuuagcgggcaucucaaaugccggaucaagauggacaaacugagacuuaagggaguguccuacagccuguguaccgcugccuucacauuuucuaaaguuccggcggagacccuccacggcacggugaccgucgaagugcaguaugccgggcgcgacggaccuugcaaggugcccgcucaaauggccguugauaugcagacacugaccccugucggccggcugaucacagcuaaccccauuaucaccgaguccacggaaaauagcagaaugaugcucgagcuggaucccccuuucggggacucuuacauugugaucggcgugggagacaagaaaauuacacaccauuggcaccgcuccggcagcaccaucgggaaggccuuugaggcgacaguccggggagccaaaagaauggcugugcuuggcgauaccgccugggacuucggguccguuggaggcguguucaacucucuggggaagggcguccaucagguguuuggagcugccuucaaaagccucuuuggcgggauguccugguucucucaaauccugauuggaacccugcuuguuuggcucggccugaauacaaagaacgggagcaucucccuggccugucucgcucugggaggcgcgaugauuuuucuuagcacggccgugucugcugaugucgggugcuccguggacuuc

SEQ ID NO: 2358 - RNA, 2061 nt, Artificial Sequence; identical to SEQ ID NO: 2193
  KU321639.1 prME-short CDS opt

SEQ ID NO: 2359 - RNA, 2061 nt, Artificial Sequence; identical to SEQ ID NO: 2194
  KU312312.1 prME-short CDS opt

SEQ ID NO: 2360 - RNA, 2049 nt, Artificial Sequence; identical to SEQ ID NO: 2195
  AY632535.2 prME-short CDS opt

SEQ ID NO: 2361 - RNA, 2061 nt, Artificial Sequence; identical to SEQ ID NO: 2196
  KU527068.1 prME-short CDS opt

SEQ ID NO: 2362 - RNA, 2061 nt, Artificial Sequence
  KX421193.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacacgggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugcc

SEQ ID NO: 2363 - RNA, 2061 nt, Artificial Sequence
  KX377335.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucacagaaagaaaggagaggcccggcgcagcagacgggcugugacccuuccgucccauucuacacgcaagcugcaaaccagaagccagacauggcucgaaucccgggaguauaccaaacaccugaucaagguugagaacuggaucuuucgcaaucccggcuucgcccugguggcggucgccauugcuuggcuccugggcagcucuacgucccagaaggugaucuaccuuguuaugauucugcucaucgccccugcuuauagcauuagaugcaucggggugucuaaccgggacuuugucgaaggaauguccggcgggacauggguggaugugguccuggagcauggaggcuguguuaccgugauggcccaggacaaacccacaguggauauugaacuugucaccaccacagugagcaauauggcggagguucgcucuuacugcuacgaggccuccaucagcgacauggcuuccgauucuagauguccuacgcaaggggaagccuaucuggacaagcagagcgacacccaguacgugugcaaacggacacucgucgaucgcggauggggcaacggcugugggcuguucggaaagggcucccuggugaccugcgcuaaauuuacaugcagcaagaagaugaccgggaaaucuauccagcccgagaaucucgaauauagaauuaugcuguccguucacggaagccaacacucuggcaugaucgugaacgacacgggguacgagacagaugaaaaucgggccaaggucgaggugaccccuaacagcccgagagccgaggcuacccuuggaggcuucggcucccuggggcucgacugugaaccccgcacaggacuggauuuuucugaccuuuauuaccugaccaugaauaacaaacauuggcucguccacaaggagugguuccaugauauuccucugcccuggcacgcgggcgccgacacagggacgccucacuggaauaacaaagaagcucugguggaguuuaaggaugcccaugccaaacggcagaccguugugguccucggaagccaggaaggcgcugugcacacagcccuggcgggggcucuugaggccgagauggacggcgccaagggaaagcuguucuccggccaucucaaaugcagacugaagauggauaaacuucgccugaaggggguuagcuauucucucuguaccgcugccuuuacauucaccaaagugcccgcugaaacgcugcacggaaccgucacaguggaggugcaguacgccggcaccgacgggccgugcaagaucccuguucaaauggcggucgacaugcagacacugacccccgugggacggcucauuacggccaauccugugaucacagaauccaccgagaacagcaagaugaugcuggaacuugauccucccuuuggcgacucuuacaucgucauuggggugggcgauaaaaagaucacacaucacuggcacagauccggaagcaccauuggcaaggcuuucgaggccaccguucgcggggcuaaacggauggccgugcugggagacacagcgugggauuucggcuccgucgggggaguguuuaacucucucggcaaagggauccaucagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugcc

SEQ ID NO: 2364 - RNA, 2061 nt, Artificial Sequence
  LC002520.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugacggugaacgacaucggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugcc

SEQ ID NO: 2365 - RNA, 2043 nt, Artificial Sequence
  DQ859059.1 prME-short CDS opt
accagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacgagaauagagcuaagguggaagucacaccuaacagcccgcgggccgaggccacccuugggggauucggcucccugggccucgauugugagcccagaaccgggcuggacuuuucugaucuuuacuaucugacaaugaauaacaaacacuggcucgugcauaaggaaugguuccacgacaucccucugcccuggcacgcuggagcggauaccggcacaccucauuggaauaacaaagaggcccugguugaauuuaaggacgcucacgccaaacgccagacgguggucgugcucgggagccaggagggagccguucauaccgcucuggccggcgcgcuugaagcugagauggauggggccaagggccggcuguucuccggacaccucaagugcagacugaaaauggacaaacuucgccugaagggcgugagcuacucucucuguacagccgcuuuuaccuucacaaagguccccgccgagacccugcaugggacggugaccguggaaguucaguaugcuggaacagauggcccgugcaaagucccugcccaaauggcgguggacaugcagacccugacacccguggggcggcucauuaccgccaauccugucaucacggaguccacagaaaacagcaagaugaugcuggagcuugacccucccuuuggagauucuuacauugugaucggcguuggggacaagaaaaucacccaccacuggcauagauccggcagcacaauuggaaaggcuuucgaagccaccgugcgcggcgcuaaacggauggccguccugggggauaccgcgugggacuucggauccgugggcgggguuuuuaacucucucggaaagggcauccaccagauuuucggggccgcuuuuaaaagccuguucggcggaauguccugguuuucucaaauccugauuggcacacuucucguguggcuggggcugaauacgaagaacggaagcaucucccucaccugucuggcccuuggcggggucaugaucuuccugagcacagcugugucugcc

SEQ ID NO: 2366 - RNA, 2049 nt, Artificial Sequence
  KU963573.2 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaaaacagagccaagguggaggucacaccuaauagcccgcgggccgaggcuacccuuggaggcuucggcucccuggggcucgauugugaacccagaaccggacuggacuuuucugaucuuuauuaccugacaaugaacaauaaacacuggcucgugcauaaggagugguuccacgacauuccucugcccuggcacgcgggcgccgauaccgggacaccucauuggaacaauaaagaagcucuggucgaguuuaaggacgcccacgccaaacgccagacggugguugugcucggaagccaggaaggcgcuguccauaccgcccuggcgggggcucuugaggccgagauggauggcgccaagggaaagcuguucuccggccaccucaaaugccggcugaagauggacaaacuuagacugaagggggugagcuauucucucuguacagcugccuuuaccuucacaaaaguucccgcugaaacccugcauggaacggugaccgucgaggugcaguacgccggcacagaugggccgugcaagaucccugugcaaauggcgguugacaugcagacccugacacccgucggacgccucauuaccgccaacccugugaucacggaauccacagagaauagcaagaugaugcuggaacuugacccucccuuuggcgauucuuacaucgugauuggggucggcgacaaaaagaucacccaccacuggcaucgguccggaagcacaauuggcaaggcuuucgaggccaccgugagaggggcuaaacgcauggccguucugggagauaccgcgugggacuucggcuccgucgggggaguguuuaacucucucggcaaagggauccaccagauuuucggcgccgcuuuuaagagccuguucggaggcauguccugguuuucucaaauccugaucgggacacuucucguguggcugggacugaacacgaagaauggcagcauuucccucaccugucuggcccuugggggaguuaugaucuuccugagcacagcugugucugcc

SEQ ID NO: 2367 - RNA, 2061 nt, Artificial Sequence
  KX694534.2 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggccgcgggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugcc

SEQ ID NO: 2368 - RNA, 2061 nt, Artificial Sequence
  KX369547.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggccuggcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucugugcacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucggggugggcgagaaaaagauuacccaccacuggcaucgcuccggaagcacaaucggcaaggccuucgaagcgaccgugagaggggccaaacggauggcuguccucggagauaccgccugggacuuuggcuccgucgggggagcucuuaauucucugggcaaggggauucaccagaucuucggcgccgccuucaaaagccuguuuggaggcauguccugguucucucaaauucucaucgggacacugcugauguggcucggacugaacacgaagaauggcagcaucucccuuaugugucuggcucucgggggaguucugauuuuucugagcaccgcggugucugcc

SEQ ID NO: 2369 - RNA, 2061 nt, Artificial Sequence
  KX447515.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacugguaucgcuccggaagcacaaucggcaaggccuuugaagcgaccgugagaggggccaaacggauggcuguccugggagauaccgccugggacuucggcuccgucgggggagcucucaauucucugggcaaggggauucaucagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugcc

SEQ ID NO: 2370 - RNA, 2061 nt, Artificial Sequence
  KU729218.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacacccagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccgucgggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggaguucucauuuuccugagcacagcggugucugcc

SEQ ID NO: 2371 - RNA, 2061 nt, Artificial Sequence
  KU501217.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgagauccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugcc

SEQ ID NO: 2372 - RNA, 2061 nt, Artificial Sequence
  KU312314.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccuggcucaaauggccguggacaugcagacccucacacccgugggaagacugaucaccgcuaacccuguuauuacggaguccacagaaaacagcaagaugaugcuugagcuggauccgcccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggaguucugauuuuccugagcaccgcggugucugcc

SEQ ID NO: 2373 - RNA, 2061 nt, Artificial Sequence
  KX446950.2 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuacccuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggagugcucauuuuccugagcacagcggugucugcc

SEQ ID NO: 2374 - RNA, 2061 nt, Artificial Sequence
  KY003157.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccguggucucugcg

SEQ ID NO: 2375 - RNA, 2061 nt, Artificial Sequence
  KX811222.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccgcuugggucguguaugggaccugucaucacaaaaagggagaagccagacggucucgcagagcuguuacgcuucccagccauuccacccggaaacugcaaacacgcccucagaccuggcucgagucuagagaguacacaaagcaccugauccggguggaaaauuggauuuuucgcaaccccggcuucgcccuggcggccgcugccaucgcuuggcuccugggcagcuccaccagccagaaagucaucuaucuugugaugauucugcucaucgccccugcguacucuauuagaugcaucgggguuuccaaucgggacuuuguggagggaaugagcggcgggacgugggucgauguggugcuggaacauggaggcugugucacaguuauggcccaggacaagcccaccguggauauugagcuugugacaaccaccgucucuaacauggcugaggugcgcuccuacugcuaugaagccagcaucucugacauggcuuccgauagcagauguccuacacaaggggaggccuaccuggacaagcaguccgacacgcaguauguuugcaaacggacccucguggaucgcggauggggcaauggcugugggcuguucggaaagggcucucuggucacaugcgccaaauuugcuugcagcaagaaaaugaccgggaaguccauucagccggaaaaccucgaguacagaaucaugcugagcgugcacggaucucaacacuccggcaugaucguuaaugacacagggcaugaaaccgaugagaaccgggcgaagguggagauuacgcccaauagcccuagagccgaagcuacacuuggaggcuucggcucucuggggcucgacugugagccccgcaccggacuggauuuuagcgaccuuuauuaccugaccaugaacaauaaacacuggcucguccauaaggaaugguuccacgauaucccucugcccuggcacgccggcgccgacacagggaccccgcauuggaacaauaaagaggcucugguggaauuuaaggaugcccacgcgaaacggcagacagucgugguucucggaucccaggagggcgcugugcauacggcccuggccggggcucuugaggccgaaauggacggcgcuaagggaagacugucuagcggccaccucaaaugccgccugaagauggauaagcugcggcugaaaggggucuccuauagccucuguaccgccgcguucacauuuaccaagauuccugccgagacacugcauggaaccgugacgguugaagugcaguacgcuggcaccgacgggcccugcaaagucccugcccaaauggcuguggacaugcagacacugacccccgugggaagacucaucacagccaaccccguuauuaccgagucuacggaaaacuccaagaugaugcuggagcuugauccuccguucggcgacagcuacaucgucaucggggugggcgagaaaaagauuacacaccacuggcaucgcucuggauccaccaucggcaaggcguuugaagccacagugagaggggcuaaacggauggccguccugggagauaccgcuugggacuucggcagcguugggggagcccucaauucccugggcaaggggauucaccagaucuucggcgccgcuuuuaaaucucuguucggaggcaugagcugguuuucccaaauucuuaucgggacccuccugauguggcugggacucaacacaaagaauggcucuaucagccugaugugucuugcgcuugggggagugcucauuuuccuguccacggccgugagcgcu

SEQ ID NO: 2376 - RNA, 2061 nt, Artificial Sequence
  KX447516.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucuaaaaaggucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcagggggaggcuuaccuggacaaacaaucugacacccaguauguuugcaagcggacacucguggaucgcggauggggcaauggcugugggcuguucggaaaaggcagccuggugaccugcgccaaguuugccugcuccaaaaagaugacagggaagucuauucagccugaaaaccucgaguacagaaucaugcugucugugcacggaucccagcacagcggcaugaucguuaaugacaccgggcaugaaacggaugagaaccgggcuaaaguggagauuacacccaauucuccgagagcggaagccacccuuggaggcuucggcagccuggggcucgacugugagccucgcaccggacuggauuuuuccgaccuuuauuaccugacaaugaacaauaagcacuggcucguccauaaagaaugguuccacgauaucccccugccuuggcacgcuggcgccgacaccgggacaccccauuggaacaauaaggaggcccugguggaauuuaaagaugcucacgccaagcggcaaacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucagauggccguggacaugcaaacccugacaccugugggaagacucaucaccgcuaaccccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaauucucugggcaaagggauucaccagaucuucggcgccgccuuuaagagccuguucggaggcauguccugguuuucucagauucuuaucgggacacuccugauguggcugggacucaacacgaaaaauggcagcaucucccugaugugucuugcucucgggggaguucugauuuuccugagcaccgcggugucugcc

SEQ ID NO: 2377 - RNA, 2061 nt, Artificial Sequence
  KX520666.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgagacagaaagucaucuaucuugugaugauucugcucaucgcucccgccuacucuauucggugcaucgggguuuccaaucgcgacuuuguggagggaaugagcggcgggacaugggucgauguggugcuggaacauggaggcugugucaccguuauggcgcaggacaagccuacaguggauauugagcuugugaccaccacagucucuaacauggccgaggugagauccuacugcuaugaagcuagcaucucugacauggccuccgauagccggugucccacgcaaggggaggcuuaccuggacaagcaguccgacacccaguauguuugcaaacgcacacucguggauagaggauggggcaauggcugugggcuguucggaaagggcucucuggugaccugcgccaaauuugccugcagcaagaaaaugacagggaaguccauucagccugaaaaccucgaguaccggaucaugcugagcgugcacggaucucaacacuccggcaugaucguuaaugacaccgggcaugaaacggaugagaacagagcuaagguggagauuacaccgaauagcccccgcgcggaagccacccuuggaggcuucggcucucuggggcucgacugugagccucggaccggacuggauuuuagcgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaaagacagacggucgugguucucggaucccaggagggcgcggugcauaccgcucuggccggggcccuugaggcugaaauggacggcgccaagggacgccugucuagcggccaccucaaaugccggcugaagauggauaagcugagacugaaaggggucuccuauagccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggacgccucaucaccgcuaaccccguuauuacggagucuacagaaaacuccaagaugaugcuggagcuugaucccccuuucggcgacagcuacaucgucaucggggugggcgagaaaaagauuacccaccacuggcaucggucuggauccacaaucggcaaggccuuugaagcgaccgugagaggggccaaacgcauggcuguccugggagauaccgccugggacuucggcagcgucgggggagcucucaauucccugggcaaggggauucaccagaucuucggcgccgccuuuaaaucucuguucggaggcaugagcugguuuucccaaauucuuaucgggacacuccugauguggcugggacucaacacgaagaauggcucuaucagccugaugugucuugcucuugggggaguucucauuuuccuguccaccgcggugagcgcc

SEQ ID NO: 2378 - RNA, 2061 nt, Artificial Sequence
  KU497555.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaacccaggagggcgcggugcauacagcucuggccggggcccuugaggcugaaauggacggcgccaagggaagacugucuagcggccaccucaaaugccgccugaagauggauaagcugcggcugaaaggggucuccuauagccucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagucuaccgaaaacuccaagaugaugcuggagcuugaucccccuuucggcgacagcuacaucgucaucggggugggcgagaaaaagauuacacaccacuggcaucgcucuggauccaccaucggcaaggccuuugaagcgaccgugagaggggccaaacggauggcuguccugggagauacagccugggacuucggcagcgucgggggagcucucaauucccugggcaaggggauucaccagaucuucggcgccgccuuuaaaucucuguucggaggcaugagcugguuuucccaaauucuuaucgggacgcuccugauguggcugggacucaacaccaagaauggcucuaucagccugaugugucuugcucuugggggaguucucauuuuccuguccacagcggugagcgcc

SEQ ID NO: 2379 - RNA, 2061 nt, Artificial Sequence
  KY075939.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacucccugagaugcauugggguuagcaaucgggacuuuguggagggaaugucuggcgggacaugggucgauguggugcuugaacauggaggcugugucaccguuauggcgcaggacaagccuacaguggauaucgagcuggugaccaccacagucuccaacauggccgaggugcgcagcuacugcuaugaagcuagcauuuccgacauggccagcgauuccagaugucccacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauccagccugaaaaccuggaguacagaauuaugcuuucugugcacggaucccaacacagcggcaugaucguuaaugacaccgggcaugaaacggaugagaaccgggcuaagguggagaucacacccaauucuccgagagcggaagccacccugggaggcuucggcagccucgggcuggacugugagccucgcaccggacuugauuuuuccgaccuguauuaccucacaaugaacaauaaacacuggcugguccauaaggaaugguuccacgauauuccccugccuuggcacgcuggcgccgacaccgggacaccccauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagaucccggcggagacccugcauggaacggugaccguugaagugcaguacgccggcacagacgggccuugcaaaguccccgcucaaauggccguggacaugcagacccucacaccugugggaagacugauuaccgcuaaccccguuaucacggaguccacagaaaacagcaagaugaugcuugagcuggaucccccuuucggcgacucuuacauugucaucggggugggcgagaaaaagaucacccaccacuggcaucgcuccggaagcacaauuggcaaggccuuugaagcgaccgugagaggggccaaacggauggcuguccucggagauaccgccugggacuucggcuccgucgggggagcucuuaauucucugggcaaggggauccaccagauuuucggcgccgccuuuaaaagccuguucggaggcauguccugguuuucucaaauccucauugggacacugcugauguggcucggacugaacacgaagaauggcagcaucucccuuaugugucuggcucucgggggaguucugaucuuccugagcaccgcggugucugcc

SEQ ID NO: 2380 - RNA, 2061 nt, Artificial Sequence
  KY075932.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggauugaaaauuggaucuuucgcaacccuggcuucgcucuggccgcggccgcuaucgccuggcuccugggcuccagcacgucucagaaagugauuuaucuugucaugauccugcucauugcucccgccuacuccaucagaugcauuggggugagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugcc

SEQ ID NO: 2381 - RNA, 2061 nt, Artificial Sequence
  KU870645.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauucugcgcaacccuggcuuugcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucuguccacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucgggauuggcgagaaaaagaucacccaccacuggcaucgcuccggaagcacaauuggcaaggccuucgaagcgaccgugagaggggccaaacggauggcugugcucggagauaccgccugggacuuuggcuccgucgggggagcucuuaauucucugggcaaggggauccaccagauuuucggcgccgccuucaaaagccuguuuggaggcauguccugguucucucaaauccucaucgggacacugcugauguggcucggacugaacacgaagaauggcagcauuucccuuaugugucuggcucucgggggagugcugaucuuucugagcaccgcgguuucugcc

SEQ ID NO: 2382 - RNA, 2061 nt, Artificial Sequence
  KU729217.2 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuuguguccaccaccgucagcaacauggccgaggugcgcucuuacugcuaugaagcuacaaucuccgacauugccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauuguuaaugacaccgggcaugaaacggaugagaaccgggcuaagguggagaucacaccgaauagccccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggcggucgugcucggaucucaggagggcgcuguucauaccgcccuggccggggcucuugaggccgaaauggacggcgcuaagggaagacugagcuccggccaccucaaaugccgccugaagauggauaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgacaugcagacccugacaccugugggaagacucauuaccgccaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggcguuugaagccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcu

SEQ ID NO: 2383 - RNA, 2061 nt, Artificial Sequence
  KX087101.3 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaacugcaguacgccggcacagacgggccuugcaaagugcccgcucaaauggccgucgacaugcagacccucacaccugugggaagacugaucaccgcuaaccccgugauuacggaguccacagaaaacagcaagaugaugcuugagcuggaucccccuuucggcgacucuuacaucguuaucggggucggcgagaaaaagauuacccaccacuggcaucgcuccggaagcacaaucggcaaggccuuugaagcgaccgugagaggggccaaacggauggcugugcucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggagugcugauuuuccugagcaccgcgguuucugcc

SEQ ID NO: 2384 - RNA, 2061 nt, Artificial Sequence
  KY014317.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccaucgaaaacagcaagaugaugcuggagcuugaucccccuuucggcgacucuuacaucgucauuggggugggcgagaaaaagaucacacaccacuggcaucgcuccggaagcaccauuggcaaggccuuugaagcgacagugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacccuccugauguggcugggacucaacacaaagaauggcagcauuucccugaugugucuugcucuugggggaguucucaucuuccugagcacggcggugucugcc

SEQ ID NO: 2385 - RNA, 2061 nt, Artificial Sequence
  KU758876.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgucaagggaagacugagcuccggccaccucaaaugccgccugaagauggauaaacuucggcugaagggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucuccuucaugugucuggcccuugggggagugcugauuuuucucagcaccgcugucucugcg

SEQ ID NO: 2386 - RNA, 2061 nt, Artificial Sequence
  KU758874.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaaaacugagcuccggccaccucaagugcagacugaagauggauaaacuucgccugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggacggcucaucaccgcuaaccccguuauuacggaguccacagaaaacagcaaaaugaugcuggagcuugaucccccuuucggcgacucuuacaucgucaucggggugggcgagaagaagauuacccaccacuggcauagauccggaagcacaaucggcaaagccuuugaagcgaccgugcgcggggccaagcggauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucucgggggaguucugauuuuccugagcaccgcggugucugcc

SEQ ID NO: 2387 - RNA, 2061 nt, Artificial Sequence
  KY317939.1 prME-short CDS opt
accagcgugggcaucgucgggcugcuccugacaacggccauggcugccgagguuaccagacggggauccgcguacuauauguaccuugaccgcaaggaugcuggcgaagccauuucuuuccccacaacccuggggaugaacaaaugcuauauccagauuauggaccucggacacaugugugaugccacaaugagcuacgagugcccuaugcuggacgaaggcguggagccggaugacguggauuguuggugcaauaccacauccaccugggucguguaugggacgugucaucacaagaaaggagaagcuagacggucucgcagagccguuacccuucccagccauuccacacggaagcugcaaacccgcucucagacauggcucgagagcagagaguacaccaaacaccugauccggguggaaaacuggauuuuucgcaauccuggcuucgcucuggccgcggccgcuaucgccuggcuccugggcuccagcacgucucagaaggucaucuaucuugugaugauucugcucaucgcucccgccuacuccauuagaugcaucgggguuagcaaccgggacuuuguggagggaaugucuggcgggacaugggucgauguggugcuggaacauggaggcugugucaccguuauggcgcaggacaagccuacaguggauauugagcuugugaccaccacagucuccaauauggccgaggugcgcagcuacugcuaugaagcuagcaucuccgacauggccagcgauuccagaugucccacgcaaggggaggcuuaccuggacaaacagucugacacccaguauguuugcaagcggacacucguggaucgcggauggggcaacggcugugggcuguucggaaaaggcagccuggugaccugcgccaaguuugccugcuccaaaaagaugacagggaagucuauucagccugaaaaucucgaguacagaaucaugcugucugugcacggaucccaacacagcggcaugaucguuaacgacaccgggcaugaaacggaugagaaucgggcuaaaguggagauuacaccgaacucucccagagcggaagccacccuuggaggcuucggcagccuggggcucgacugugagccucgcaccggacuggauuuuuccgaccuuuauuaccugacaaugaauaacaagcacuggcucguccauaaagaaugguuccacgauaucccccugccuuggcacgcuggcgccgacaccgggacaccccauuggaauaacaaggaggcccugguggaauuuaaagaugcucacgccaagcggcagacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggaagacucaucaccgcuaaucccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaacucucugggcaaagggauucaccagaucuucggcgccgccuuuaagagccuguucggaggcauguccugguuuucucaaauucuuaucgggacacuccugauguggcugggacucaauacgaaaaacggcagcaucucccugaugugucuugcucucgggggaguucugauuuuccugagcaccgcggugucugcc

SEQ ID NO: 2388 - RNA, 2061 nt, Artificial Sequence
  KY014314.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaggcucacgccaaacggcagacggucgugguucucggaucucaggagggcgcggugcauaccgcucuggccggggcccuugaagcugagauggauggcgccaagggaagacugagcuccggccaccucaaaugccgccugaagauggacaaacuucggcugaaaggggucagcuauucucucuguacagcugccuucaccuuuacaaagauuccggcggaaacccugcauggaacggugaccguugaggugcaguacgccggcacagaugggccuugcaaaguccccgcucaaauggccguggacaugcagacccugacaccugugggaagacucaucaccgcuaaccccguuauuacggaauccacagagaacagcaagaugaugcuggagcuugacccgccuuucggcgauucuuacaucgucaucggggugggcgaaaagaagauuacccaccacuggcaucgcuccggaagcacaaucggcaaggccuuugaggcgaccgugagaggggccaaacggauggcuguccugggagacaccgccugggauuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucucgggggaguucugauuuuccugagcaccgcggugucugcc

SEQ ID NO: 2389 - RNA, 2061 nt, Artificial Sequence
  KX447517.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccgcucuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaacccuuauugggacacuccugauguggcugggacucaacacgaagaauggcagcaucucccugaugugucuugcgcuugggggaguucucaucuuccugagcaccgccgugucugcu

SEQ ID NO: 2390 - RNA, 2061 nt, Artificial Sequence
  KU926310.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcgcugacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggaguucucauuuuccugagcacggccgugucugcu

SEQ ID NO: 2391 - RNA, 2061 nt, Artificial Sequence
  KU922923.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugccccaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucuggccuacuccauuagaugcaucgggguuagcaaucgggacuuuguggagggaaugucuggcgggacaugggucgauguggugcuugaacauggaggcugugucaccguuauggcgcaggacaagcccacaguggauauugagcuggugaccaccacagucuccaacauggccgaggugcgcagcuacugcuaugaagcuagcaucuccgacauggccagcgauuccagauguccuacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauucagcccgaaaaccuggaguacagaaucaugcuuucugugcacggaucccaacacagcggcaugaucguuaaugacaccgggcaugaaacggaugagaaccgggcuaagguggagauuacaccuaauucuccgagagcggaagccacccugggaggcuucggcagccucgggcuggacugugagccccgcaccggacuugauuuuuccgaccuguauuaccucacaaugaacaauaaacacuggcugguccauaaggaaugguuccacgauaucccucugcccuggcacgcuggcgccgacaccgggacaccucauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagauucccgcggagacccugcauggaacggugaccguugaagugcaguacgccggcacagacgggccgugcaaagucccugcucaaauggccguggacaugcagacccucacacccgugggaagacugaucaccgcuaacccuguuauuacggaguccacagaaaacagcaagaugaugcuugagcuggauccucccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuguucggaggcauguccugguuuucucaaauucucaucgggacacugcugauguggcucggacugaacacgaagaauggcagcaucucccuuaugugucuggcucucgggggaguucugauuuuccugagcaccgcggugucugcc

SEQ ID NO: 2392 - RNA, 2061 nt, Artificial Sequence
  KY075937.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacaugguuagcgauuccagaugucccacgcaaggggaggccuaccuggacaagcagucugacacccaguaugugugcaaacggacacucgucgaucgcggauggggcaauggcugugggcuguucggaaagggcagccuggugaccugcgcuaaauuugccugcuccaagaaaaugacagggaagucuauucagccugaaaaccucgaguacagaaucaugcugucuguucacggaucccaacacagcggcaugaucgugaaugacaccgggcaugaaacggaugagaaccgggccaaggucgagauuacacccaauucuccgagagcugaagcgacccuuggaggcuucggcagccuggggcucgacugugagccucgcaccggacuggauuuuuccgaccuuuauuaccugacaaugaacaauaaacacuggcucgugcauaaggaaugguuccacgauaucccccugccuuggcacgccggcgcugacaccgggacaccccauuggaacaauaaagaggcccuggucgaauuuaaggaugcccacgcuaaacggcagacggugguugugcucggaucucaggagggcgccguccauaccgcgcuggcuggggcccuugaggccgaaauggacggcgcuaagggaagacugagcuccggccaccucaaaugccgccugaagauggauaagcugcggcugaaaggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucucccugaugugucuugcccuugggggagugcucauuuuccugagcaccgcugucucugcg

SEQ ID NO: 2393 - RNA, 2061 nt, Artificial Sequence
  KY003156.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggauuagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcauucuggggcucgacugugagccucgcaccggacuggauuuuagcgaccuuuauuaccugacaaugaacaauaaacacuggcucgugcauaaggaaugguuccacgauaucccccugccuuggcacgcuggcgccgacaccgggacaccccauuggaacaauaaagaggcccuggucgaauuuaaggaugcucacgccaaacggcagacgguggucgugcucggaucccaggagggcgcgguucauaccgcucuggccggggcccuugaggcugaaauggacggcgccaagggaagacugucuagcggccaccucaaaugccgccugaagauggauaagcugcggcugaaagggguguccuauagccucuguacagcugccuucaccuuuacaaagauuccggcggagacccugcauggaacggucaccguggaaguucaguacgccggcacagacgggccuugcaaagugcccgcucaaauggccgucgacaugcagacccugacaccugugggaagacucaucaccgcuaaccccgugaucacggagucuacagaaaacuccaagaugaugcuggagcuugaucccccuuucggcgacagcuacauuguuaucggggucggcgagaaaaagauuacccaccacuggcaucgcucuggauccacaaucggcaaggccuuugaagcgaccgugagaggggccaaacggauggcugugcugggagauaccgccugggacuucggcagcgucgggggagcucucaauucccugggcaaggggauucaccagaucuucggcgccgccuuuaaaucucuguucggaggcaugagcugguuuucccaaauccuuauugggacacuccugauguggcugggacucaacacgaagaauggcucuaucagccugaugugucuugcucuugggggagugcucauuuuccuguccaccgcgguuagcgcc

SEQ ID NO: 2394 - RNA, 2061 nt, Artificial Sequence
  KU312313.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccauccggaaacugcaaacccgcucucagacauggcucgagagcagagaguacaccaagcaccugauucggguggaaaauuggaucuuucgcaacccuggcuucgcucuggccgcggccgcuaucgccuggcuccugggcuccagcacgucucagaaagucauuuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucugugcacggaucccaacacagcggcaugauuguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacaucgucauuggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacgcuaagaauggcagcauuucccugaugugucuugcgcuugggggaguucucaucuuccugagcacggccgugucugcu

SEQ ID NO: 2395 - RNA, 2061 nt, Artificial Sequence
  KY075935.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcucaaagaucucggcgcgccguuacccuucccagccauuccacaagaaaacugcagacccggucucagacauggcucgagagccgcgaguacaccaagcaccugaucagaguggaaaauuggauuuuucggaacccuggcuucgcucuggccgcggccgcuaucgccuggcuccugggcuccagcacgucucagaaagucaucuaucuugugaugauucugcucaucgcucccgccuacuccauucgcugcaucgggguuagcaauagagacuuuguggagggaaugucuggcgggacaugggucgauguggugcuggaacauggaggcugugucaccguuauggcgcaagacaagccuacaguggauauugagcuugugaccaccacagucuccaacauggccgaggugcggagcuacugcuaugaagcuagcaucuccgacauggccagcgauucccgcugucccacgcagggggaggcuuaccuggacaagcagucugacacccaguauguuugcaaaagaacacucguggaucggggauggggcaauggcugugggcuguucggaaagggcagccuggugaccugcgccaaauuugccugcuccaagaaaaugacagggaagucuauucaaccugaaaaccucgaguaccgcaucaugcugucugugcacggaucccagcacagcggcaugaucguuaaugacaccgggcaugaaacggaugagaacagagcuaagguggagauuacacccaauucuccgcgggcggaagccacccuuggaggcuucggcagccuggggcucgacugugagccuagaaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacgccagacggucgugguucucggaucucaggagggcgcggugcauaccgcucuggccggggcccuugaggcugaaauggacggcgccaagggacggcugagcuccggccaccucaaaugcagacugaagauggauaagcugcgccugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggacggcucaucaccgcuaaccccguuauuacggaguccacagaaaacagcaagaugaugcuggagcuugaucccccuuucggcgacucuuacaucgucaucggggugggcgagaaaaagauuacccaccacuggcauagauccggaagcacaaucggcaaggccuuugaagcgaccgugcgcggggccaaacggauggcuguccugggagauaccgccugggacuucggcuccgucgggggagcucucaauucucugggcaaggggauucaccaaaucuucggcgccgccuuuaaaagccuguucggaggcauguccugguuuucucagauucuuaucgggacacuccugauguggcugggacucaacacgaagaauggcagcaucucccugaugugucuugcucuugggggaguucucauuuuccugagcaccgcggugucugcc

SEQ ID NO: 2396 - RNA, 2061 nt, Artificial Sequence
  KY014320.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaagcucgcucucagaccuggcucgagagcagagaguacacaaagcaccugauccggguggaaaauuggauuuuucgcaacccuggcuucgcccuggcggccgcugccaucgcuuggcuccugggcuccagcaccucucagaaagucaucuaucuugugaugauucugcucaucgcccccgcguacuccauuagaugcaucgggguuagcaaucgggacuuuguggagggaaugucuggcgggacgugggucgauguggugcuggaacauggaggcugugucacaguuauggcccaggacaagccuaccguggauauugagcuugugacaaccaccgucuccaacauggcugaggugcgcagcuacugcuaugaagccucuaucuccgacauggcuagcgauuccagaugucccacacaaggggaggccuaccuggacaagcagucugacacgcaguauguuugcaaacggacccucguggaucgcggauggggcaauggcugugggcuguucggaaagggcagccuggucacaugcgccaaauuugcuugcuccaagaaaaugaccggaaagagcauucagccugaaaaccucgaguacagaaucaugcugucugugcacgggucccaacacagcggcaugaucguuaaugacacagggcaugaaaccgaugagaaccgggcgaagguggagauuacgcccaauucucccagagccgaagcuacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccguugggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggagugcucauuuuccugagcacggccgugucugcu

SEQ ID NO: 2397 - RNA, 2061 nt, Artificial Sequence
  KY328290.1 prME-short CDS opt
accagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaaacuucggcugaaaggggucucuuauucccucuguacagcugccuucaccuuuagcaagauuccggcggagacacugcauggaaccgugacggaagagguucaguacgccggcaccgacgggccuugcaaagugcccgcucaaauggccgucgacaugcagacacugaccccugugggaagacucaucacagcuaaucccgugauuaccgaaucuacggagaacuccaagaugaugcuggagcuugaucccccuuucggcgacagcuacaucguuaucggggucggcgaaaagaagauuacacaccacuggcaucgcuccggaucuaccaucggcaaggccuuugaggcgacagugagaggggccaaacggauggcugugcugggagauaccgccugggacuucggcagcgucgggggagcucucaacucccugggcaaggggauucaccagaucuucggcgccgccuuuaaaucucuguucggaggcaugagcugguuuucccaaauucuuaucgggacccuccugauguggcugggacucaauacaaagaacggcagcaucucucugaugugucuugcucucgggggagugcugauuuuccuguccacggcgguuagcgcc

SEQ ID NO: 2398 - RNA, 2061 nt, Artificial Sequence
  KU681081.3 prME-short CDS opt
accagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacaccggcgcugacacagggacgccccauuggaauaacaaagaggcccugguggaauuuaaggaugcccacgcuaaacggcagaccgucgugguucucggaagccaggagggcgccgugcauacagcgcuggcuggggcccuugaggccgaaauggacggcgcuaagggaagacuguccagcggccaccucaaaugccgccugaagauggauaaacuucggcugaagggggucucuuauucccucuguaccgccgcuuucacauuuaccaagauuccggccgagacgcugcauggaaccgugacaguugaagugcaguacgcgggcaccgacgggccuugcaaaguccccgcccaaauggcuguggacaugcagacacugaccccugugggaagacucaucacggccaaucccguuauuacagagggcaccgaaaacagcaagaugaugcuggagcuugaucccccuuucggggacucuuacaucgucaucggcgugggagagaaaaagauuacacaccacuggcaucgcuccggcagcaccaucgggaaggcuuuugaagccaccgugcggggagcgaaaagaauggccguccugggcgauacagcuugggacuucggguccgugggaggcguucucaacucucuggggaagggcauucaccagaucuucggagccgcuuuuaaaagccuguucggcgggauguccugguuuucucaaauucuuaucggaacgcuccugauguggcugggccucaauaccaagaacgggagcaucucccugaugugucuugcccugggaggcgugcucauuuuccugagcacagccgucucugcu

SEQ ID NO: 2399 - RNA, 2061 nt, Artificial Sequence
  KX827309.1 prME-short CDS opt
accagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugaugugucuugcucuugggggaguucucauuuuccugucuaccgcgguguccgcc

SEQ ID NO: 2400 - RNA, 2061 nt, Artificial Sequence
  KU955593.1 prME-short CDS opt
accagcgugggcaucgucgggcugcuccugacaacggccauggcuguugaggugaccagacggggaaacgccuacuauauguaccuugaccgcuccgaugcgggcgaagcuauuucuuuccccacaaccauggggaugaauaagugcuauauccagauuauggaccugggacacaugugugaugccacaaugagcuacgagugcccuaugcucgacgaaggcguggagccggaugacgucgauuguuggugcaacaccacauccaccugggugguuuaugggacgugucaucacaaaaagggagaagccagacggucucgcagagcugugacccugcccagccauuccacacggaaacuucaaacccgcucucagacauggcuggagagcagagaguacaccaagcaccucauccgggucgaaaauuggauuuuucgcaacccuggcuucgcccuggcugccgcggccaucgcuuggcugcucggcuccagcacgucucagaaagugaucuaucugguuaugauucuucugaucgcccccgcuuacuccauuagaugcaucggggugagcaaucgggacuuugucgagggaaugucuggcgggacauggguggaugugguccucgaacauggaggcuguguuaccgugauggcccaggacaagccuacaguggauauugagcuggucaccaccacaguguccaacauggcggagguucgcagcuacugcuaugaagccucuaucuccgacauggcuagcgauuccagaugucccacgcaaggggaggccuaccuugacaagcagucugacacccaguaugugugcaaacggacacuggucgaucgcggauggggcaauggcugugggcuguucggaaagggcagccuggugaccugcgcuaaauuugccugcuccaagaaaaugacagggaagucuauucagccugaaaaccuggaguacagaaucaugcucucuguucacggaucccaacacagcggcaugaucgugaaugacaccgggcaugaaacggaugagaaccgggccaaggucgagauuacaccgaauagccccagagcugaagcgacccugggaggcuucggcagccuugggcuggacugugagccucgcaccggacucgauuuuuccgaccuguauuaccuuacaaugaacaauaaacacuggcuggugcauaaggaaugguuccacgauaucccccucccuuggcacgccggcgcugacaccgggacaccccauuggaacaauaaagaggcccuggucgaauuuaaggaugcccacgcuaaacggcagacggugguugugcugggaucucaggagggcgccguccauaccgcgcucgcuggggcccuggaggccgaaauggacggcgcuaagggaagacuuagcuccggccaccugaaaugccgccucaagauggauaagcugcggcuuaaaggggugagcuauucucuguguacagccgcuuucaccuuuacaaagauuccggccgagacccuccauggaacgguuaccguggaaguccaguacgcgggcacagacgggccuugcaaagugcccgcccaaauggcuguggacaugcagacccugacaccuguuggaagacugaucaccgccaaccccgucauuacggaguccacagaaaacagcaagaugaugcucgagcuggaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcuuggagauaccgcuugggacuucggcuccguugggggagcccucaauucucucggcaaggggauucaccagaucuucggcgcugccuuuaaaagccuguucggaggcauguccugguuuucucaaauucugaucgggacacuucucguguggcugggacugaacacgaagaauggcagcaucucccucaugugucuggcccuugggggaguccugauuuuccucagcaccgcugugucugcg

SEQ ID NO: 2401 - RNA, 2061 nt, Artificial Sequence
  KY272987.1 prME-short CDS opt
accagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugguuugucuugcucuugggggagugcucauuuuccugucuaccgcggucuccgcc

SEQ ID NO: 2402 - RNA, 2061 nt, Artificial Sequence
  KY007221.1 prME-short CDS opt
accagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuaacaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugguuugucuugcucuugggggagugcucauuuuccugagcaccgcggucucugcc

SEQ ID NO: 2403 - RNA, 2061 nt, Artificial Sequence
  EU545988.1 prME-short CDS opt
accagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggccaucgcuuggcuccugggcagcucuacgucccagaaagugaucuaucuuguuaugauucugcucaucgcccccgcuuacagcauuagaugcaucggggugucuaaccgggacuuugucgagggaauguccggcgggacauggguggaugugguccuggaacauggaggcuguguuaccgugauggcccaggacaagccugcgguggauauugagcuugucacaaccaccgugagcaauauggccgagguucgcucuuacugcuaugaagccuccaucagcgacauggcuuccgauucuagaugucccacacaaggggaggcuuaccuggacaagcagagcgacacgcaguaugugugcaaacggacccucgucgaucgcggauggggcaacggcugugggcuguucggaaagggcucccuggugacaugcgccaaauuugccugcagcaagaaaaugaccgggaagucuauucagccugaaaaucucgaguacagaaucaugcuguccguucacggaagccaacacucuggcaugaucgugaacgacacagggcaugaaaccgaugagaaucgggcuaaggucgagauuacgccgaacagccccagagcggaagccacacuuggaggcuucggcucccuggggcucgacugugagccucgcaccggacuggauuuuucugaccuuuauuaccugaccaugaauaacaaacacuggcucgugcauaaggaaugguuccacgauaucccccugccuuggcacgcuggcgccgacacagggacaccccauuggaauaacaaagaggcccuggucgaauuuaaggaugcucacgccaaacggcagaccgugguugugcucggaagccaggagggcgcgguccauacggcucuggccggggcccuugaggcugaaauggacggcgccaagggaagacuguccagcggccaccucaaaugccgccugaagauggauaagcugcggcugaaaggggugucuuauucccucuguaccgcugccuucacauuuaccaagauuccggcggagacacugcauggaaccguuacgguggaaguccaguacgccggcaccgacgggccuugcaaagugcccgcucaaauggccguggacaugcagacacugaccccuguuggaagacucaucacagcuaaucccgucauuaccgagagcacggaaaacucuaagaugaugcuggagcuugaucccccuuucggcgacuccuacaucgugaucggggugggcgagaaaaagauuacacaccacuggcaucgcagcggauccaccaucggcaaggccuuugaagcgacagucagaggggccaaacggauggcugugcugggagauaccgccugggacuucggcucuguugggggagcucucaacagccugggcaaggggauucaccagaucuucggcgccgccuuuaaaucccuguucggaggcaugucuugguuuagccaaauucuuaucgggacccuccugguguggcugggacucaauacaaagaacggcuccaucagccugacgugucuugcucuugggggaguccucauuuuccugucuaccgcgguguccgcc

SEQ ID NO: 2404 - RNA, 2061 nt, Artificial Sequence
  KU681082.3 prME-short CDS opt
accagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggugaucgccuggcuccugggcagcucuacgucccagaaaguuaucuaucuugugaugauucugcucaucgcucccgccuacagcauuagaugcaucggggucucuaaccgggacuuuguggagggaauguccggcgggacauggguggaugucguucuggaacauggaggcugugugaccgugauggcucaggacaagccuacagucgauauugagcuugugaccaccacaguuagcaauauggccgaggugcgcucuuacugcuaugaagcguccaucagcgacauggccuccgauucuagaugucccacgcaaggggaggcuuaccuggacaagcagagcgacacccaguaugucugcaaacggacacucguggaucgcggauggggcaacggcugugggcuguucggaaagggcucccugguuaccugcgccaaauuugcuugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagccgaagcuacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcgggcgccgacaccgggacaccccauuggaauaacaaagaggcucugguggaauuuaaggaugcccacgccaaacggcagacgguugugguccucggaagccaggagggcgcugugcauaccgcccuggcgggggcucuugaggccgaaauggacggcgccaagggaagacuguccagcggccaccucaaaugccgccugaagauggauaagcugcggcugaaagggguuucuuauucccucuguacagcugccuucaccuuuacaaagauuccggcugagacccugcauggaacggugaccgucgaagugcaguacgccggcacagacgggccuugcaaagugcccgcgcaaauggccguugacaugcagacccugacaccugucggaagacucaucaccgcuaaucccgugauuacggagagcacagaaaacucuaagaugaugcuggagcuugaucccccuuucggcgacuccuacaucgugaucggggucggcgagaaaaagauuacccaccacuggcaucgcagcggauccacaaucggcaaggccuuugaagcuaccgugagaggggccaaacggauggcgguucugggagauaccgccugggacuucggcucugucgggggagcucucaacagccugggcaaggggauucaccagaucuucggcgccgcuuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagccguuuccgcu

SEQ ID NO: 2405 - RNA, 2061 nt, Artificial Sequence
  KX601167.1 prME-short CDS opt
accagcgugggcaucgucgggcugcuccugacaacggccauggcuguugaggugaccagacggggauccgccuacuauauguaccuugaccgcucugaugcgggcgaagcuauuagcuuccccacaacccugggggugaacaagugcuauauccagauuauggaccucggacacaugugugaugccacaauguccuacgagugcccuaugcuggacgaaggcgucgagccggaugacguggauuguuggugcaauaccacaucuaccuggguuguguaugggacgugucaucacaaaaagggagaagccagacggagccgcagagcugucacccuucccucccauucuacacggaaacugcaaacccgcagccagacauggcucgaguccagagaguacaccaagcaccugauccggguggaaaacuggauuuuucgcaauccuggcuucgcccuggcugccgcggccaucgcuuggcuccugggcagcucuacgucccagaaaguuaucuaucuugugaugauucugcucaucgcccccgcuuacagcauuagaugcaucggggucucuaaccgggacuuuguggagggaauguccggcgggacauggguggaugucguucuggaacauggaggcugugugaccgugauggcccaggacaagccuacagucgauauugagcuugugaccaccacaguuagcaauauggcggaggugcgcucuuacugcuaugaagccuccaucagcgacauggcuuccgauucuagaugucccacgcaaggggaggccuaccuggacaagcagagcgacacccaguaugucugcaaacggacacucguggaucgcggauggggcaacggcugugggcuguucggaaagggcucccugguuaccugcgcuaaauuugccugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagcugaagcgacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgccggcgcugacaccgggacaccccauuggaauaacaaagaggcccugguggaauuuaaggaugcccacgcuaaacggcagacgguugugguccucggaagccaggagggcgccgugcauaccgcgcuggcuggggcccuugaggccgaaauggacggcgcuaagggaagacuguccagcggccaccucaaaugccgccugaagauggauaagcugcggcugaaagggguuucuuauucccucuguacagccgcuuucaccuuuacaaagauuccggccgagacccugcauggaacggugaccgucgaagugcaguacgcgggcacagacgggccuugcaaagugcccgcccaaauggcuguugacaugcagacccugacaccugucggaagacucaucaccgccaaucccgugauuacggagagcacagaaaacucuaagaugaugcuggagcuugaucccccuuucggcgacuccuacaucgugaucggggucggcgauaaaaagauuacccaccacugguaucgcagcggauccacaaucggcaaggcuuuugaggccaccgugagaggggcgaaacggauggccguucugggagacaccgcuugggauuucggcucugucgggggagcccucaacagccugggcaaggggauucaucagaucuucggcgcugccuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagcuguuuccgcg

SEQ ID NO: 2406 - RNA, 2061 nt, Artificial Sequence
  KX694533.2 prME-short CDS opt
accagcgugggcaucgucgggcugcuccugacaacggccauggcuguugaggugaccagacggggauccgccuacuauauguaccuugaccgcucugaugcgggcaaggcuauuagcuuccccacaacccugggggugaacaaaugcuauauccagauuauggaccucggacacaugugugaugccacaauguccuacgaaugcccuaugcuggacgagggcgucgaaccggaugacguggauuguuggugcaauaccacaucuaccuggguuguguaugggacgugucaucacaagaaaggagaggccagacggagccgcagagcugucacccuucccucccauucuacacggaagcugcaaacccgcagccagacauggcucgaauccagagaguacaccaaacaccugauccggguggagaacuggauuuuucgcaauccuggcuucgcccuggcugccgcggccaucgcuuggcuccugggcagcucuacgucccagaagguuaucuaucuugugaugauucugcucaucgcccccgcuuacagcauuagaugcaucggggucucuaaccgggacuuuguggaaggaauguccggcgggacauggguggaugucguucuggagcauggaggcugugugaccgugauggcccaggacaagccuacagucgauauugaacuugugaccaccacaguuagcaauauggcggaggugcgcucuuacugcuaugaggccuccaucagcgacauggcuuccgauucuagaugucccacgcaaggggaagccuaccuggacaaacagagcgacacccaguaugucugcaagcggacacucguggaucgcggauggggcaacggcugugggcuguucggaaaaggcucccugguuaccugcgcuaaguuugccugcagcaaaaagaugacagggaagucuauucagccugagaaucucgaauacagaaucaugcuguccgugcacggaagccaacacucuggcaugaucgucaacgacauugggcaugagaccgaugaaaaucgggccaaaguggagaucacgccgaacagccccagagcugaggcgacacuuggaggcuucggcucccuggggcucgacugugaaccucgcaccggacuggauuuuucugaccuuuauuaccugaccaugaauaacaagcacuggcucguccauaaagagugguuccacgauauuccccugccuuggcacgccggcgcugacacagggacaccccauuggaauaacaaggaagcccugguggaguuuaaagaugcccacgcuaagcggcagacaguugugguccucggaagccaggaaggcgccgugcauacggcgcuggcuggggcccuugaggccgagauggacggcgcuaaaggaagacuguccagcggccaccucaagugccgccugaagauggauaaacuucggcugaaggggguuucuuauucccucuguaccgccgcuuucacauuuaccaaaaucccggccgaaacacugcauggaaccgugacggucgaggugcaguacgcgggcaccgacgggccuugcaaggugcccgcccaaauggcuguugacaugcagacacugaccccugucggaagacucauuacagccaaucccgugaucaccgaaagcacggagaacucuaaaaugaugcuggaacuugaucccccuuucggcgacuccuacaucgugauuggggucggcgauaagaagaucacacaccacuggcaucgcagcggauccaccauuggcaaggcuuuugaggccacagugagaggggcgaaacggauggccguucugggagacaccgcuugggauuucggcucugucgggggagcccucaacagccugggcaaagggauccaccagauuuucggcgcugccuuuaagucccuguucggaggcaugucuugguuuagccaaauccuuaucgggacccuccugguguggcugggacucaauaccaaaaacggcuccauuagccugacgugucuugcccucgggggagugcugaucuuccugucuaccgcuguuuccgcg

SEQ ID NO: 2407 - RNA, 2061 nt, Artificial Sequence
  KY288905.1 prME-short CDS opt
accagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacacagggcacgagaccgaugaaaauagagcuaagguggaggucaccccuaacagcccgcgggccgaggccacacuuggaggcuucggcucccuggggcucgacugugaacccagaaccggacuggauuuuucugaccuuuacuaucugacaaugaauaacaaacauuggcucgugcacaaggagugguuccacgauaucccucugcccuggcaugcuggcgcggacacggggaccccucacuggaauaacaaagaagcccugguugaguuuaaggaugcucaugccaaacgccagacaguggucgugcucggaagccaggaaggcgccguucacaccgcucuggccggggcgcuugaggcugagauggacggcgccaagggacggcuguucuccggccaucucaagugcagacugaaaauggauaaacuucgccugaagggggugagcuacucucucuguacagccgcuuuuaccuucacgaagguccccgccgaaacccugcacggaacagugaccguggagguucaguaugcuggcacagacgggccgugcaaagucccugcccaaauggcgguggacaugcagacccugacgcccgugggacggcucauuacagccaauccugucaucaccgaauccacagagaacagcaagaugaugcuggaacuugauccucccuuuggcgacucuuacauugugaucgggguuggcgauaagaaaaucacccaccauuggcacagauccggaagcaccauuggcaaggcuuucgaggccacagugcgcggggcuaaacggauggccguccugggagacacggcgugggauuucggcuccguugggggaguguuuaacucucucggcaaggggauccaucagauuuucggcgccgcuuuuaaaagccuguucggaggcauguccugguuuucucaaauccugauugggacccuucucguguggcugggacugaauacaaagaacggcagcaucucccucaccugucuggcccuugggggagucaugaucuuccugagcacagcugugucugcc

SEQ ID NO: 2408 - RNA, 2061 nt, Artificial Sequence
  KF268950.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacauugggcacgagaccgaugaaaacagagccaagguggaggucacgccuaauagcccgcgggcugaggcgacacuuggaggcuucggcucccuggggcucgacugugaacccagaaccggacuggauuuuucugaccuuuacuaucugaccaugaacaauaaacauuggcucgugcacaaggagugguuccacgauaucccucugcccuggcaugccggcgcugacacagggaccccucacuggaacaauaaagaagcccuggucgaguuuaaggaugcccaugcuaaacgccagacagugguugugcucggaagccaggaaggcgccguccacacggcgcuggcuggggcccuugaggccgagauggacggcgcuaagggacggcuguucuccggccaucucaagugcagacugaaaauggauaaacuucgccugaagggggugagcuacucucucuguaccgccgcuuuuacauucaccaagguucccgccgaaacacugcacggaaccgugacggucgaggugcaguaugcgggcaccgacgggccgugcaaagugccugcccaaauggcuguugacaugcagacacugacccccgucggacggcucauuacagccaacccugugaucaccgaauccacggagaacagcaagaugaugcuggaacuugauccucccuuuggcgacucuuacaucgugauuggggucggcgauaagaaaaucacacaccauuggcacagauccggaagcaccauuggcaaggcuuucgaggccacagugcgcggggcgaaacggauggccguucugggagacaccgcuugggauuucggcuccgucgggggaguguuuaauucucucggcaagggggugcaucagaucuucggcgccgcuuuuaaaagccuguucggaggcauguccugguuuucucaaauucugaucgggacccuucucguuuggcugggacugaacacaaagaauggcagcaucucccucacgugucuggcccuugggggagugaugauuuuccugagcaccgccgucucugcu

SEQ ID NO: 2409 - RNA, 2061 nt, Artificial Sequence
  KF383121.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacauugggcacgagacggaugaaaauagagccaaggucgaggugacaccuaacagcccgcgggccgaggcuacccuuggaggcuucggcucccuggggcucgacugugaacccagaaccggacuggauuuuucugaccuuuacuaucugacaaugaauaacaaacauuggcucguccacaaggagugguuccacgauaucccucugcccuggcaugcgggcgccgacaccgggacaccucacuggaauaacaaagaagcucugguggaguuuaaggaugcccaugccaaacgccagacgguugugguccucggaagccaggaaggcgcugugcacaccgcccuggcgggggcucuugaggccgagauggacggcgccaagggacggcuguucuccggccaucucaagugcagacugaaaauggauaaacuucgccugaaggggguuagcuacucucucuguacagcugccuuuaccuucacaaaggugcccgcugaaacccugcacggaacggucaccguggaggugcaguaugccggcacagacgggccgugcaaaguuccugcgcaaauggccgucgacaugcagacccugacacccgugggacggcucauuaccgcuaauccugugaucacggaauccacagagaacagcaagaugaugcuggaacuugauccucccuuuggcgacucuuacaucgucauuggggugggcgauaagaaaaucacccaccauuggcacagauccggaagcacaauuggcaaggccuucgaggcuaccguucgcggggccaaacggauggcggugcugggagacaccgccugggauuucggcuccgucgggggaguguuuaacucucucggcaaggggauccaucagauuuucggcgcugccuuuaaaagccuguucggaggcauguccugguuuucucaaauccugaucgggacacuucucguuuggcugggacugaauacgaagaacggcagcauuucccucaccugucuggcucuugggggagugaugaucuuccugagcacagccgucucugcc

SEQ ID NO: 2410 - RNA, 2043 nt, Artificial Sequence
  KF268949.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacgagaacagagccaagguggaagucaccccuaauagcccgcgggcugaggcgacgcuugggggauucggcucccugggccucgauugugagcccagaacagggcuggacuuuucugaucuuuacuaucugaccaugaacaauaaacacuggcucgugcauaaggaaugguuccacgacauuccucugcccuggcacgccggagcugauaccggcacaccucauuggaacaauaaagaggcccuggucgaauuuaaggacgcccacgcuaaacgccagaccgugguugugcucgggagccaggagggagccguccauacagcgcuggcuggcgcccuugaagccgagauggauggggcuaagggccggcuguucuccggacaccucaagugcagacugaaaauggacaaacuucgccugaagggcgugagcuacucucucuguacggccgcuuuuaccuucacaaagguucccgccgagacccugcaugggacagugaccgucgaagugcaguaugcgggaacggauggcccgugcaaagugccugcccaaauggcuguugacaugcagacccugacacccgucgggcggcucaucaccgccaacccugugauuacagaguccaccgaaaacagcaagaugaugcuggagcuugacccucccuuuggagauucuuacaucgugaucggcgucggggacaagaaaauuacgcaccacuggcauagauccggcagcacaaucggaaaggcuuucgaagccaccgugcgcggcgcgaaacggauggccguucugggggauacagcuugggacuucggauccgugggcggggucuuuaauucucucggaaagggcauucaccagaucuucggggccgcuuuuaaaagccuguucggcggaauguccugguuuucucaaauucugaucggcacccuucucguguggcuggggcugaacaccaagaauggaagcaucucccucacaugucuggcccuuggcgggguuaugauuuuccugagcacggccgugucugcu

SEQ ID NO: 2411 - RNA, 2061 nt, Artificial Sequence
  KU955595.1 prME-short CDS opt
accagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacacggggcacgagacagaugaaaauagagccaagguggaggucaccccuaacagcccgcgggccgaggcuacccuuggaggcuucggcucccuggggcucgacugugaacccagaacaggacuggauuuuucugaccuuuacuaucugaccaugaauaacaaacauuggcucgugcacaaggagugguuccacgauaucccucugcccuggcaugcgggcgccgacacagggacgccucacuggaauaacaaagaagcucugguugaguuuaaggaugcccaugccaaacgccagaccguggucgugcucggaagccaggaaggcgcuguucacacagcccuggcgggggcucuugaggccgagauggacggcgccaagggacggcuguucuccggccaucucaagugcagacugaaaauggauaaacuucgccugaagggggugagcuacucucucuguaccgcugccuuuacauucaccaagguccccgcugaaacgcugcacggaaccgugacaguggagguucaguaugccggcaccgacgggccgugcaaagucccugcgcaaauggccguggacaugcagacacugacccccgugggacggcucauuacggcuaauccugucaucacagaauccaccgagaacagcaagaugaugcuggaacuugauccucccuuuggcgacucuuacauugugaucgggguuggcgauaagaaaaucacacaccauuggcacagauccggaagcaccauuggcaaggccuucgaggcuaccgugcgcggggccaaacggauggcgguccugggagacacagccugggauuucggcuccguugggggaguguuuaacucucucggcaaggggauccaucagauuuucggcgcugccuuuaaaagccuguucggaggcauguccugguuuucucaaauccugauugggacgcuucucguguggcugggacugaauaccaagaacggcagcaucucccucacaugucuggcucuugggggagucaugaucuuccugagcaccgccgugucugcc

SEQ ID NO: 2412 - RNA, 2061 nt, Artificial Sequence
  KF383116.1 prME-short CDS opt
accagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaacacaagaaaggagaggccagacggagccgcagagcuguuacccuuccgucccauucuacacggaagcugcagacccgcagccagacauggcucgaauccagagaguauaccaaacaccugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcauggaggcugugugaccgugauggcccaagacaaacccacagucgauaucgaacuugugaccaccacaguuagcaauauggcggaggugcggucuuacugcuacgaggccuccauuagcgacauggcuuccgauucucgcuguccuacgcagggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccaacccgagaaucucgaauaucgcaucaugcuguccgugcacggaagccagcacucuggcaugauugucaacgacaucgggcaugagacggaugaaaauagagccaagguggaggucacaccuaacagcccgcgggccgaggcuacccuuggaggcuucggcucccuggggcucgacugugaacccagaaccggacuggauuuuucugaccuuuacuaucugacaaugaauaacaaacacuggcucgugcauaaggagugguuccacgauauuccucugcccuggcacgcgggcgccgacaccgggacaccucauuggaauaacaaagaagcucugguugaguuuaaggaugcccacgccaaacgccagacgguggucgugcucggaagccaggaaggcgcuguucauaccgcccuggcgggggcucuugaggccgagauggacggcgccaagggacggcuguucuccggccaccucaagugcagacugaaaauggauaaacuucgccugaagggggugagcuacucucucuguacagcugucugcaccgccgcuaaggugcccgccgaaacacugcauggaaccgugacgguugagguccaauaugcgggcaccgacgggccguguaaagugccugcccagauggcuguggacaugcagacacugacccccgucggacggcucaucacagccaauccugugauuaccgaauccacggagaacagcaagaugaugcuggaacuugauccucccuuuggcgacucuuacaucguuaucggggugggcgauaagaaaauuacacaccacuggcauagauccggaagcaccaucggcaaggcuuucgaggccacaguccgcggggcgaaacggauggccgugcugggagacaccgcuugggauuuuggcuccguugggggaguguucaacucucucggcaaggggauucaccaaaucuucggcgccgcuuuuaaaagccuguucggaggcauguccugguuuucucagauucugaucgggacccuucucgucuggcugggacugaauacaaagaacggcagcaucucccucacgugccuggcccuugggggagugaugauuuuccugagcaccgccguuucugcu

SEQ ID NO: 2413 - RNA, 2043 nt, Artificial Sequence
  KX601166.1 prME-short CDS opt
accagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacgagaauagagccaagguggaagucacgccuaacagcccgcgggccgaggcuacacuugggggauucggcucccugggccucgauugugagcccagaaccgggcuggacuuuucugaucuuuacuaucugaccaugaauaacaaacacuggcucgugcauaaggaaugguuccacgacaucccucugcccuggcacgcgggagccgauacaggcaccccucauuggaauaacaaagaggcucugguugaauuuaaggacgcccacgccaaacgccagacaguggucgugcucgggagccaggagggagcuguucauacggcccuggcgggcgcucuugaagccgagauggauggggccaagggccggcuguucuccggacaccucaagugcagacugaaaauggacaaacuucgccugaagggcgugagcuacucucucuguaccgcugccuuuacauucaccaagguccccgcugagacacugcaugggaccgugacgguggaaguucaguaugccggaaccgauggcccgugcaaagucccugcgcaaauggccguggacaugcagacacugacccccguggggcggcucauuacagcuaauccugucaucaccgaguccacggaaaacagcaagaugaugcuggagcuugacccucccuuuggagauucuuacauugugaucggcguuggggacaagaaaaucacacaccacuggcauagauccggcagcaccauuggaaaggccuucgaagcuacagugcgcggcgccaaacggauggcgguccugggggauaccgccugggacuucggauccgugggcgggguuuuuaacucucucggaaagggcauccaccagauuuucggggcugccuuuaaaagccuguucggcggaauguccugguuuucucaaauccugauuggcacccuucucguguggcuggggcugaauacaaagaacggaagcaucucccucacgugucuggcucuuggcggggucaugaucuuccugagcaccgccgugucugcc

SEQ ID NO: 2414 - RNA, 2061 nt, Artificial Sequence
  KF383118.1 prME-short CDS opt
accagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaaccugaugacguggauuguuggugcaauaccacaucuaccuggguggucuacgggacgugucaccauaagaaaggagagaccagacggagccgcagauccgugucucuucgguaucacuacacacgcaagcugcaaaccagaagccagacauggcucgaaucccgggaguauaaaaagcaucugaucaugguugagaacuggaucuuucgcaauccgggcuucgccauugugagcgucgcuaucaccuggcugaugggcucucucacgucccagaaggugauuuaccugguuaugaucgugcuuauuguccccgccuacagcaucucuugcauugggguguccaacagagaccugguggaaggaaugagcggcgggacaugggucgauguugugcucgagcacggaggcugugugaccgaaauggcgcaggacaaaccuacagucgauaucgagcuggugaccaugaccguuucuaauauggccgaggugcgguccuauugcuacgaagcuagccuuuccgacauggccucugcuagccgcugucccacacaaggggagccuucccuggauaagcagagcgacacgcagucugucugcaaaagaacccucggagaccggggcuggggcaacggguguggaaucuuuggcaaggggucccuggugacaugcagcaaauuuaccugcuguaagaagaugcccggaaaaucuauucagccugaaaaucuggaguaucgcaucaugcucccgguucacggcagccaacauuccgggaugauugugaacgauaucggacacgaaacagacgagaauagagccaaggucgaggugacccccaacucuccucgggcggaagccacgcugggcggcuuugggagccuuggacuggauugcgagcccagaacaggccucgacuucuccgaucuguacuaucuuaccaugaauaacaaacauuggcugguccacaaggaaugguuucacgacauuccucuccccuggcaugcuggggccgauaccggaacaccgcacuggaauaacaaagaggcucugguggaguucaaggacgcccaugccaaacgccagaccguugugguccugggcagccaggaaggggcugugcacacagcgcucgccggcgcucuggaggccgaaauggauggagccaagggccggcuuuucucugggcaucugaaguguagacucaaaauggacaagcugcgccuuaaaggaguuuccuacagccugugcacggcugccuucaccuuuacaaaggugccugcggagacccuccacggcacagucaccguggaagugcagucugcugggacggauggacccuguaaaguuccugcccaaauggccgucgacaugcagacccugacacccgugggccggcugaucaccgcuaaucccgugaucacagaguccaccgaaaacagcaagaugaugcucgagcuggacccuccguucggggauuccuauauugucaucggcgugggagacaagaaaauuacgcaccauuggcacagaucuggcagcacaaucgggaaggccuuugaggcuaccguucgcggagccaaacggauggcggugcuuggcgauacagccugggacuucggguccgucggaggcguguucaacucucuggggaagggcauucaucagaucuuuggagcugccuucaaaagccucuuuggcgggauguccugguucagccaaauccugauuggaacccugcuuguuuggcucggccugaauaccaagaacgggucuaucucccugacaugccucgcucugggaggcgugaugauuuuucuuagcacggccgucucugcg

SEQ ID NO: 2415 - RNA, 2058 nt, Artificial Sequence
  KX447520.1 prME-short CDS opt
agcgugggcaucgucgggcugcuccugaccacagccauggcugccgagguuacgagacggggauccgcguacuauauguaccuugaccgcaacgaugcuggcgaagccauuucuuuccccaccacacuggggaugaauaagugcuauauccagauuauggaccucggacacaugugugaugccaccaugagcuacgagugcccuaugcuggacgaaggcguggagccggaugacguggauuguuggugcaacacaaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugcc

SEQ ID NO: 2416 - RNA, 2061 nt, Artificial Sequence
  KU761561.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggcccggcgcauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugcc

SEQ ID NO: 2417 - RNA, 2061 nt, Artificial Sequence
  KX806557.2 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauguuucgcaacccuggcuucgcucuggccgcggccgcuauugccuggcuccugggcuccagcacgucucagaaagucaucuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaauuaugcugucugugcacggaucccaacacagcggcaugaucguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacauugucaucggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuauugggacacuccugauguggcugggacucaacacgaagaauggcagcaucucccugaugugucuugcucuugggggaguucucaucuuccugagcaccgcggugucugcc

SEQ ID NO: 2418 - RNA, 2061 nt, Artificial Sequence
  LC191864.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaugaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugcc

SEQ ID NO: 2419 - RNA, 2061 nt, Artificial Sequence
  KU744693.1 prME-short CDS opt
accagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccgcgauggcccaggacaagccuacaguugauauugagcuugugaccaccacaguguccaacauggcugagguccgcagcuacugcuaugaagccucuaucuccgacauggcuagcgauuccagaugucccacgcaaggggaggccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauucagccugaaaaccucgaguacagaaucaugcugucuguccacggaucccaacacagcggcaugcuugugaaugacaccgggcaugaaacggaugagaaccgggcgaagguugagaucacaccgaauagccccagagccgaagcuacccugggaggcuucggcagccucgggcuggacugugagccucgcaccggacuugauuuuuccgaccuguauuaccucacaaugaacaauaaacacuggcuggcccauaaggaaugguuccacgauauuccccugccuuggcacgccggcgcugccaccgggacaccccauuggaacaauaaagaggcgcucguggaauuuaaggacgcucacgccaaacggcagacggucgugguccugggaucucaggagggcgccgugcauaccgcucuugccggggcucuggaggccgaaauggauggcgcgaagggaagacucagcuccggccaccugaaaugccgccuuaagauggacaagcugcggcucaaagggguuagcuauucucuguguacagccgcuuucaccuuuacaaagaucccggccgagaccguggauggaacggucaccguggaaggccaguacgggggaacagacggcccuugcaaaguucccgcucaaauggccguggacaugcagacccugacaccugucgggagacucauuaccgcgaaccccgugaucacggaguccacagaaaacagcaagaugaugcuggagcuugaucccccuuucggcgacucuuacauugugaucggaguuggcgagaaaaagaucacccaucacuggcaccgcuccgggagcacaauuggaaaggccuuugaagcuaccguccggggcgccaaaagaauggcugugcugggggauaccgccugggacuucggauccgugggcggggcccucaauucucugggcaagggaauccaucagauuaucggcgcugcguucaaaagccuguuugggggaauguccugguucucucaaauucuuaucggcacacuccugauguggcuggggcucaacacgaagaauggaagcaucucccugaugugucuugcccugggcgggguccucauuuuucugagcaccgcugugucuggc

SEQ ID NO: 2420 - RNA, 2052 nt, Artificial Sequence
  KU963574.2 prME-short CDS opt
ggcgccgacgcuagcaucgggauugugucccugcuccugaccacagucauggccgcggagaucacgagacggggaucugcuuacuauauguaccuugaucgcagcgacgccggcaaggccauuuccuucguuaccacacugggggugaacaaaugccacgugcagaucauggaucucggacauaugugugacgcuaccaugucuuaugaaugccccaugcuggaugagggcgucgaacccgacgauguggacuguuggugcaauacaaccagcacauggguuguguacgggaccugucaccauaagaaaggagaggccagacggucccgcagagcugucacgcuuccgucucacagcacccggaagcugcaaacacgcucccagaccuggcucgaaagcagagaguauacaaaacaucugauuaagguggagaacuggaucuuucggaaucccggcuucgcccugguugcgguggccaucgcuuggcuccugggaucuuccaccagccagaaggucauuuaccuugugaugauccugcucauugccccugcuuauucuauccgcugcauugggguguccaacagagauuuugucgaaggaaugagcggcgggacguggguugacguggugcuggagcacggaggcugugucacagugauggcccaggauaaacccaccguugacaucgaacuugugacaaccaccgucucuaauauggcggaggugcgguccuacugcuacgaggccagcauuuccgauauggcuucugacagccgcuguccuacacaaggggaagccuaucuggacaagcaguccgauacgcaguacguuugcaaaagaacccucguggaccggggauggggcaacggcugugggcuguucggaaagggcagccuggucacaugcgcuaaauuuaccugcucuaagaagaugacagggaaauccauccagcccgagaaucucgaauaucgcaucaugcugagcgugcacggaucucaacauagcggcaugauugucaacgaugagaauagagccaagguggaaguuaccccuaacuccccgcgggccgaggcuacgcuugggggauucggcucucugggccucgacugugagcccagaacagggcuggauuuuagcgaccuuuacuaucugaccaugaauaacaaacacuggcucgugcauaaggaaugguuccacgauaucccucugcccuggcacuccggagcggacaccgagacaccucauuggaauaacaaagaagcccuggucgaguuuaaggaugcucacgccaaacgccagaccgugguugugcucggcagccaggaaggggccguccauacagcucuggccggagcgcuugaggcugagauggacggcgccaaggggcggcugucuuccggccaccucaagugcagacugaaaauggauaaacuucgccugaagggagugagcuacucucucuguacggccgcuuucaccuuuacaaaggugcccgccgaaacccugcauggcacaguuaccgucgaggugcaguaugcugggcgggacggaccgugcaaagugccugcccaaauggcggucgacaugcagacgcugacccccgugggcagacucauuacagccaauccuguuaucaccgaauccacagagaacagcaagaugaugcuggaacuugauccucccuucggggacuccuacauugugaucggagucggcgauaagaaaaucacccaccacuggcaucgcucugggagcauuaucggcaaggcuuuugaggccacggugcggggagcuaaaagaauggccguucugggcgacacagcgugggauuucggguccgugggaggcgucuucaacucucucgggaagggcauucaccagaucuuuggcgccgcuuucaaaagccuguuugggggcauguccugguucagccaaauucugaucggaacccuucucguguggcugggccugaauacaaagaacgggucuaucucccucaccugucuggcccuuggaggcguuaugauuuuucugagcaccgcugugucugcc

SEQ ID NO: 2421 - RNA, 2070 nt, Artificial Sequence
  KF383120.1 prME-short CDS opt
ggcgccgacaccagcaucgggauuaucggacugcuccugacaacggcuauggccgcggagauuaccagacggggcuccgcuuacuauauguaccuugaucgcucugacgccgggaaggccaucagcuucgcuacaaccaugggagugaacaaaugccacguccagauuauggaucugggccauaugugugacgccacaauguccuaugaaugccccaugcucgaugaggggguugaaccugacgauguggacuguuggugcaauaccacaucuaccuggguggucuacggaacgugucaccauaagaaaggcgaggcuagaccgagccggcgcgccgugacccugcccucccacucuacaagaaaacuucaaacccggagccagacauggcuggaaucccgcgaguauaccaagcaucucaucaagguugagaacuggauccugagaaauccuggcuuuacgguggcggcccuggcuauggccuggcuccuggggaacagcacaucucagcgggucauuuaccuugugaugauccugcucauugcucccgccuauuccauccgcugcauuggaguuagcaauagagauuucguggaaggcaugucugggggaaccugggucgacguggugcuggagcacggcgggugugucacaguuauggcgcaggauaagccuaccguggacaucgaacuugugaccacaacggucuccaacauggccgaggugcggagcuacugcuacgaggcuucuauuuccgauauggccagcgacucccgcugucccacccaaggagaggcuuaucuggacaaacagucugauacacaguacguuugcaagagaacccucguggaccggggcuggggcaauggguguggacuguuuggcaaagggagccuggucacaugcgccaaguuuaccugcuccaaaaagaugacgggaaagagcauccagccugaaaaccucgaauaucgcaucaugcugucugugcacggcucccaacauagcgggaugauuguuaaugauaucggacacgagacagacgaaaacagagccaaaguggaggucacccccaauucuccccgggcugaggcgacccuuggcggcuucgggagccugggacucgauugugaaccuagaacaggccuggacuucuccgaucuuuacuaucugaccaugaacaauaagcauuggcucgugcacaaagagugguuucacgacauuccccugccuuggcaugccggggcugauacaggaacgccccacuggaacaauaaggaagcccuggucgaguucaaagacgcccaugcuaagcgccagaccgugguugugcucggcucucaggaaggggccguccacacagcgcuggcuggcgcccuugaggccgagauggauggagcuaaaggccggcuguuuagcgggcaucucaagugcagaaucaagauggacaaacugcgccuuaagggaguguccuacagccuguguaccgccgcuuucacauuuucuaaaguuccggccgaaacccuccacggcacggugaccgucgaggugcaguaugcggggcgggacggaccuugcaaggugcccgcccaaauggcuguugauaugcagacacugaccccugucggcagacugauuacagccaaccccaucaucaccgaauccacggagaacagccgcaugaugcucgaacuggacccgccuuucggggauucuuacauugugaucggcgugggagacaaaaagauuacacaccauuggcaccgguccggcagcaccaucgggaaggcuuuugaggccacagucagaggagcgaaacgcauggccgugcuuggcgauaccgcuugggacuucggguccguuggaggcguguucaauucucuggggaagggcguccaucagguguuuggagccgcuuucaaaagccucuuuggcgggauguccugguucucucaaauucugaucggaacccugcuuguuuggcucggccugaacacaaagaaugggagcaucucccuggccugucucgcccugggaggcgcuaugauuuuucuuagcacggcggugucugcc

SEQ ID NO: 2422 - RNA, 1353 nt, Artificial Sequence; identical to SEQ ID NO: 2197
  KU321639.1 solE CDS opt

SEQ ID NO: 2423 - RNA, 1353 nt, Artificial Sequence; identical to SEQ ID NO: 2198
  KU312312.1 solE CDS opt

SEQ ID NO: 2424 - RNA, 1341 nt, Artificial Sequence; identical to SEQ ID NO: 2199
  AY632535.2 solE CDS opt

SEQ ID NO: 2425 - RNA, 1353 nt, Artificial Sequence; identical to SEQ ID NO: 2198
  KU527068.1 solE CDS opt

SEQ ID NO: 2426 - RNA, 1353 nt, Artificial Sequence
  KX421193.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucu

SEQ ID NO: 2427 - RNA, 1353 nt, Artificial Sequence
  LC002520.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugacaguuaacgauaucggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucu

SEQ ID NO: 2428 - RNA, 1335 nt, Artificial Sequence
  DQ859059.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacgcgggggccgacacgggaacaccgcacuggaauaacaaagaagcucugguggaguucaaggacgcccaugcuaagcggcagaccguugugguccucggcagccaggaaggggccgugcacacagcgcuggccggagcucuggaggccgaaauggauggcgcuaaagggcgccucuuuuccggacaucugaaguguagacuuaaaauggacaagcugcggcucaaaggcguuucuuacagccugugcaccgccgccuucaccuuuacaaaggugcccgcugagacgcuucacggcaccgucacaguggagguccaauaugcggggaccgauggaccuuguaaagugcccgcccagauggcuguugacaugcagacacugaccccugugggccgccucaucacggccaaucccgucauuacagaauccaccgagaacagcaagaugaugcuggaacuggauccgccuuucggggacucuuacaucgugauuggaguuggcgauaagaaaaucacccaccauuggcacagauccgggagcacaaucggcaaggccuuugaggcuaccgugcggggagccaaacgcauggcgguccucggcgacacagcuugggauuucgggucu

SEQ ID NO: 2429 - RNA, 1341 nt, Artificial Sequence
  KU963573.2 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugagaaccgggccaagguugaagugaccccuaauagcccccgcgcugaggccacacucgggggauuuggcucucugggccuggacugcgagccuagaaccgggcuugauuucuccgaccuguacuaccucacgaugaacaauaaacauuggcuggugcacaaggaaugguuucaugauauuccccuuccuuggcacgcgggagccgacacaggcaccccgcacuggaacaauaaagaggcucuggucgaguucaaggacgcccaugcuaagcggcagacagugguugugcucgggagccaggaaggagccguccacaccgcgcuggccggcgcucuggaagccgagauggauggggcuaaaggaaagcucuuuuccggccaucugaaaugucgccuuaagauggacaaacugagacucaagggcgugucuuauagccugugcaccgccgccuucacauuuacgaaaguucccgcugagacccuucacgggacagugaccgucgaagugcaauacgcgggaacagauggcccuuguaagauccccguccagauggccguggacaugcagacccugacgccuguugggcggcucauuacagcuaaccccgugaucaccgaguccaccgaaaauagcaagaugaugcuggagcuggauccgccuuucggagacucuuauauugucaucggcgugggggauaaaaagaucacacaccauuggcaccgcuccggcagcaccauuggaaaagccuuugaagccacaguuagaggcgcuaagcggauggccgugcucggggacacggcgugggauuucggaucu

SEQ ID NO: 2430 - RNA, 1353 nt, Artificial Sequence
  KY075939.1 solE CDS opt
agccagaaggugaucuaccuggucaugauucuccugaucgcccccgcuuauucccuuagaugcauuggcguuucuaaccgggacuucguggaggggaugagcggaggcaccuggguggaugucgugcuggaacacgggggauguguuacagugauggcccaagacaaaccuacggucgauaucgagcucgugaccacaaccguuuccaauauggcggaagugcgcucuuacugcuaugaggcuagcauuuccgacauggccucugauagcagauguccgacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaacccgagaaucuggaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuugauugcgagccuagaaccgggcuggacuucuccgaucucuauuaccugacgaugaauaacaaacacuggcuugugcauaaggaaugguuucacgacauuccccugccuuggcacgccggagcugacacaggcaccccgcauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauccccgcggagacccugcacgggacaguuaccguggaaguccaauaugccggaacagacggcccuuguaaagugcccgcucagauggccgucgauaugcagacccucacgccuguggggcgccugauuacagccaaucccguuaucaccgagagcaccgaaaacucuaagaugaugcuggagcucgacccgccuuuuggagauuccuacauugugaucggcgucggggaaaagaaaaucacacaucacuggcauagaagcggcucuaccauuggaaaggcuuucgaggccacagugcggggcgcgaaacgcauggcuguucugggggacacggccugggauuuuggaagc

SEQ ID NO: 2431 - RNA, 1353 nt, Artificial Sequence
  KX447516.1 solE CDS opt
agcaagaaagugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaggacaagccuacggucgauauugagcuggugaccacaaccguuuccaauauggcggaagugcgcucuuacugcuaugaggcuagcaucuccgacauggccucugauagcagauguccgacacaaggcgaagccuaccucgacaaacaguccgauacccaguaugucugcaagcggacacugguggaccgcggguggggaaacggcuguggccuuuuugggaaaggaagccuggugaccugcgcuaaguucgccuguucuaagaaaaugacgggcaaguccauccagcccgagaaucucgaguacagaauuaugcugagcguccaugggucucaacacuccggaaugaucguuaacgauaccggccaugaaacagacgagaaucgggcuaaaguggaaauuaccccuaacagcccccgcgccgaggcgacacucgggggauuuggcucucugggccuggauugcgagccuagaaccgggcuugacuucuccgaucuguauuaccucacgaugaauaacaagcacuggcuggugcauaaagaaugguuucacgacaucccccuuccuuggcacgccggagcugacacaggcaccccgcauuggaauaacaaggaggcccuggucgaguucaaggaugcucacgccaaacggcagacagugguugugcucgggagccaggaaggagcgguccauaccgcccuggcuggcgcccuggaagcugagauggacggggccaagggacgccucuccucuggccaccugaaauguagacuuaagauggauaaacugcggcucaagggcgugagcuacucccugugcaccgccgcuuuuacauucacgaaaauucccgcggagacccuucacgggacaguuaccguggaaguccaguaugccggaacagacggcccuuguaaggugcccgcucaaauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggagaaaaagauuacacaucacuggcauagaagcggcucuaccaucggaaaggcuuucgaagccacagugcggggcgcgaaacgcauggcuguucucggggacacggccugggauuuuggaagc

SEQ ID NO: 2432 - RNA, 1353 nt, Artificial Sequence
  KX447515.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacugguauagaagcggcucuaccaucggaaaggcuuucgaggccacagugcggggcgcgaaacgcauggcuguucucggggacacggccugggauuuuggaagc

SEQ ID NO: 2433 - RNA, 1353 nt, Artificial Sequence
  KU758874.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggaaagcucuccucuggccaccugaaaugucgccuuaagauggauaaacugagacucaagggcgugagcuacucccugugcaccgccgcuuuuacauucacgaaaauucccgcggagacccuucacgggacaguuaccguggaaguccaauaugccggaacagacggcccuuguaaggugcccgcucagauggccgucgauaugcagacccugacgccuguggggcggcucaucacagccaaucccguuauuaccgagagcaccgaaaacucuaagaugaugcuggagcuggacccgccuuuuggagauuccuacaucgugaucggcgucggggagaaaaagauuacacaucacuggcaucgcagcggcucuaccaucggaaaggcuuucgaagccacagugagaggcgcgaaacggauggcuguucucggggacacggccugggauuuuggaagc

SEQ ID NO: 2434 - RNA, 1353 nt, Artificial Sequence
  KU729218.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauacccagacgcugacaccuguggggcgccucaucaccgccaaucccguuauuaccgagagcacagaaaacucuaagaugaugcuggagcuggacccgccuuuuggagauuccuacaucgugaucggcgucggggaaaagaaaauuacccaucacuggcauagaagcggcucuacaaucggaaaggcuuucgaggccacggugcggggcgcgaaacgcauggcuguucucggggacaccgccugggauuuuggaagc

SEQ ID NO: 2435 - RNA, 1353 nt, Artificial Sequence
  KU501217.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaaauccgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagc

SEQ ID NO: 2436 - RNA, 1353 nt, Artificial Sequence
  KU761561.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgcgcagaauggcuguucucggggacacggccugggauuuuggaagc

SEQ ID NO: 2437 - RNA, 1353 nt, Artificial Sequence
  KY075937.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggucucugauagcagauguccgacacagggcgaagccuaccucgacaagcaguccgauacccaguaugugugcaaacggacacugguggaccgcggguggggaaacggcuguggccuuuuugggaagggaagccugguuaccugcgccaaauucgcuuguucuaagaagaugacgggcaaauccauccaacccgagaaucucgaguacagaauuaugcugagcguccaugggucucagcacuccggaaugaucgugaacgauaccggccaugaaacagacgagaaucgggccaagguggaaauuaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagc

SEQ ID NO: 2438 - RNA, 1353 nt, Artificial Sequence
  KY014317.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaucgaaaacucuaagaugaugcuggagcuggacccgccuuuuggagauuccuacaucgugauuggcgucggggaaaagaaaaucacccaucacuggcauagaagcggcucuacaauuggaaaggcuuucgaggccaccgugcggggcgcgaaacgcauggcuguucucggggacacagccugggauuuuggaagc

SEQ ID NO: 2439 - RNA, 1353 nt, Artificial Sequence
  KU870645.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcauuggggaaaagaaaaucacacaucacuggcauagaagcggcucuaccauuggaaaggcuuucgaggccacaguccggggcgcgaaacgcauggcugugcucggggacacggccugggauuuuggaagc

SEQ ID NO: 2440 - RNA, 1353 nt, Artificial Sequence
  KU922923.1 solE CDS opt
agccagaaggugaucuaccuggucaugauucuccugaucgcccuugcuuauuccauuagaugcaucggcguuucuaaccgggacuucguggaggggaugagcggaggcaccuggguggaugucgugcuggaacacgggggauguguuacagugauggcccaagacaaacccacggucgauauugagcucgugaccacaaccguuuccaauauggcggaagugcgcucuuacugcuaugaggcuagcaucuccgacauggccucugauagcagauguccuacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaaccggagaaucuggaguacagaauuaugcugagcguccaugggucucagcacuccggaaugaucguuaacgauaccggccaugaaacagacgagaaucgggcuaagguggaaauuacccccaacagcccucgcgccgaggcgacacucgggggauuuggcucucugggccuugauugcgagcccagaaccgggcuggacuucuccgaucucuauuaccugacgaugaauaacaaacacuggcuugugcauaaggaaugguuucacgacaucccucugcccuggcacgccggagcugacacaggcaccccucauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauuccggcggagacccugcacgggacaguuaccguggaaguccaauaugccggaacagacggccccuguaaagugccugcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagc

SEQ ID NO: 2441 - RNA, 1353 nt, Artificial Sequence
  KU497555.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggacccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcacagccgcuuuuacguucaccaagauucccgcggagacacuucacgggaccguuacaguggaaguccaauaugccggaaccgacggcccuuguaaagugcccgcucagauggccgucgauaugcagacgcugacaccuguggggcgccucaucaccgccaaucccguuauuaccgaguccacagaaaacagcaagaugaugcuggagcuggacccgccuuuuggagauucuuacaucgugaucggcgucggggaaaagaaaauuacccaucacuggcauagauccggcagcacaaucggaaaggcuuucgaggccacggugcggggcgcgaaacgcauggcuguucucggggacaccgccugggauuuuggaucu

SEQ ID NO: 2442 - RNA, 1353 nt, Artificial Sequence
  KU312314.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcuggcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagc

SEQ ID NO: 2443 - RNA, 1353 nt, Artificial Sequence
  KY014314.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaagcucacgccaagcggcagacagugguugugcucgggagccaggaaggagcgguccauaccgcccuggcuggcgcccuggaggcugagauggauggggccaaaggacgccucuccucuggccaccugaaguguagacuuaaaauggacaagcugcggcucaaaggcgugagcuacucccugugcaccgccgcuuuuacauucacgaagauucccgcggaaacccuucacgggacaguuaccguggagguccaauaugccggaacagauggcccuuguaaagugcccgcucagauggccgucgacaugcagacccugacgccuguggggcgccucaucacagccaaucccguuauuaccgaaagcaccgagaacucuaagaugaugcuggaacuggauccgccuuuuggagacuccuacaucgugaucggcgucggggagaagaaaauuacacaucacuggcauagaagcggcucuaccaucggaaaggcuuucgaggccacagugcggggcgcgaaacgcauggcuguucucggggauacggccugggacuuuggaagc

SEQ ID NO: 2444 - RNA, 1353 nt, Artificial Sequence
  KX447517.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcggcccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagc

SEQ ID NO: 2445 - RNA, 1353 nt, Artificial Sequence
  KU729217.2 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcugguguccaccacaguuucuaauauggcggaagugcgcagcuacugcuaugaggcuaccaucuccgacaucgccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauucaacccgagaaucucgaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccuggucgaguucaaggaugcucacgccaagcggcagacagcggugguucucgggagccaggaaggagccgugcauaccgcucuggccggcgcucuggaagccgagauggacggggccaaaggacgccucuccucuggccaccugaaguguagacuuaaaauggauaagcugcggcucaaaggcgucagcuacucccugugcaccgcugcguuuacauucacgaagauccccgccgagacccuucacgggacagugaccguugaagugcaauaugcuggaacagacggcccuuguaaaguccccgcccagauggccguggauaugcagacccugacgccugucgggcgccucauuacagcuaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggccuucgaggcgacaguccggggcgcuaaacgcauggccgugcucggggacacggccugggauuuuggaagc

SEQ ID NO: 2446 - RNA, 1353 nt, Artificial Sequence
  KY328290.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucagcaagauucccgcggagacgcuucacgggaccguuacagaagaggugcaauaugccggaaccgacggcccuuguaaaguccccgcucagauggccguggauaugcagacacugaccccugucgggcgccucaucacggccaaucccgugauuacagaaucuaccgagaacuccaagaugaugcuggaacuggacccgccuuuuggagauagcuacaucguuaucggcgugggggagaagaaaauuacccaucacuggcauagaucuggcagcacaaucggaaaggcuuucgaggccaccguccggggcgcgaaacgcauggcugugcucggggacacagccugggauuuuggaucc

SEQ ID NO: 2447 - RNA, 1353 nt, Artificial Sequence
  KX087101.3 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaacugcaauaugccggaacagacggcccuuguaaaguccccgcucagauggccguggauaugcagacccucacgccugucgggcgccugaucacagccaaucccgugauuaccgagagcaccgaaaacucuaagaugaugcuggagcucgacccgccuuuuggagauuccuacaucguuaucggcgugggggaaaagaaaauuacacaucacuggcauagaagcggcucuaccaucggaaaggcuuucgaggccacaguccggggcgcgaaacgcauggcugugcugggggacacggccugggauuuuggaagc

SEQ ID NO: 2448 - RNA, 1353 nt, Artificial Sequence
  KY003156.1 solE CDS opt
agccagaaggugaucuaccuggucaugauucuccugaucgcccccgcuuauuccauuagaugcaucggcauuucuaaccgggacuucguugaggggaugagcggaggcaccuggguggaugugguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcauucugggccuggauugcgagccuagaaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccugguggaguucaaggaugcucacgccaagcggcagacagucgugguucucgggucccaggaaggagcggugcauaccgcccuggcuggcgcccuggaagcugagauggacggggccaaaggacgccucagcuccggccaccugaaguguagacuuaaaauggauaagcugcggcucaaaggcgucucuuacagccugugcaccgccgcuuuuacauucacgaagauucccgcggagacccuucacgggacagugaccguugaagugcaauaugccggaacagacggcccuuguaaaguccccgcucagauggccguggauaugcagacccugacgccugucgggcgccucaucacagccaaucccgugaucaccgaguccaccgaaaacagcaagaugaugcuggagcuggacccgccuuuuggagauucuuacauuguuaucggcgugggggaaaagaaaauuacacaucacuggcauagauccggcagcaccaucggaaaggcuuucgaggccacaguccggggcgcgaaacgcauggcugugcucggggacacggccugggauuuuggaucu

SEQ ID NO: 2449 - RNA, 1353 nt, Artificial Sequence
  KU758876.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggugaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagc

SEQ ID NO: 2450 - RNA, 1353 nt, Artificial Sequence
  KU926310.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggagcugacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagc

SEQ ID NO: 2451 - RNA, 1353 nt, Artificial Sequence
  KU681081.3 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacacaggagccgacaccggcacaccgcauuggaauaacaaagaggcucuggucgaguucaaggaugcccacgcuaagcggcagaccgugguugugcucgggagccaggaaggagccguccauaccgcgcuggccggcgcucuggaagccgagauggacggggcuaaaggacgccucuccucuggccaccugaaguguagacuuaaaauggauaagcugcggcucaaaggcgugagcuacucccugugcacagccgccuuuacguucaccaagauucccgcugagacacuucacgggaccguuacaguggaaguccaauaugcgggaaccgacggcccuuguaaagugcccgcccagauggcugucgauaugcagacgcugacaccuguggggcgccucaucaccgccaaucccguuauuaccgagggaacagaaaacagcaagaugaugcuggagcuggacccgccuuuuggcgauucuuacaucgugaucggggucggcgaaaagaaaauuacccaucacuggcauagauccggaagcacaaucggcaaggccuucgaggcuacggugcgcggggccaaacggauggcgguucucggagacaccgcuugggauuuuggcucu

SEQ ID NO: 2452 - RNA, 1353 nt, Artificial Sequence
  KU744693.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagccauggcgcaagacaaaccuacgguggauauugagcuggucaccacaaccguguccaauauggcugaaguucgcucuuacugcuaugaggccagcaucuccgacauggccucugauagcagauguccgacacagggcgaggcuuaccucgacaagcaguccgauacccaguaugugugcaaacggacacuggucgaccgcggguggggaaacggcuguggccuuuuugggaagggaagccuggugaccugcgccaaauucgcuuguucuaagaagaugacgggcaaauccauccaacccgaaaaucucgaguacagaauuaugcugagcgugcaugggucucagcacuccggaaugcuggucaacgauaccggccaugaaacagacgagaaucgggccaagguugaaaucaccccuaacagcccccgcgcggaggccacacucgggggauuuggcucucugggccuugauugcgagccuagaaccgggcuggacuucuccgaucucuauuaccugacgaugaauaacaaacacuggcuugcucauaaggaaugguuucacgacauuccccugccuuggcacgccggagcugccacaggcaccccgcauuggaauaacaaagaggcgcucguggaguucaaggacgcccacgcuaagcggcagacaguggucgugcuggggagccaggaaggagccguucauaccgcucuggccggcgcccucgaagcugagauggauggggcgaaaggacgccuguccucuggccaccuuaaguguagacugaaaauggacaagcuccggcugaaaggcgugagcuacucccuuugcaccgccgcuuuuacauucacgaagauccccgccgagaccgucgaugggacagugaccguugaaggacaauauggcgggacagacggaccuuguaaagugcccgcccagauggcugucgauaugcagacccugacgccugugggccgccucauuacagccaaucccgucaucaccgagagcaccgaaaacucuaagaugaugcuggagcuggacccgccuuuuggggauuccuacauugugaucggcguuggagaaaagaaaaucacacaccauuggcacagaagcggcucuaccauugggaaggcguucgaggcuacagugcggggagccaaacgcauggccguccucggcgacacggcuugggauuuugggagc

SEQ ID NO: 2453 - RNA, 1353 nt, Artificial Sequence
  EU545988.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccugcggucgauauugagcuggugacgaccacaguuuccaauauggcugaagugcgcucuuacugcuaugaggccagcaucuccgacauggccucugauagcagauguccgacccagggcgaggcuuaccucgacaagcaguccgauacacaguaugucugcaaacggacccugguggaccgcggguggggaaacggcuguggccuuuuugggaagggaagccuggugacaugcgccaaauucgcuuguucuaagaagaugaccggcaaauccauccaacccgaaaaucucgaguacagaauuaugcugagcguccaugggucucagcacuccggaaugaucguuaacgauacgggccaugaaaccgacgagaaucgggccaagguggaaauuacaccuaacagcccccgcgcggaggccacccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagc

SEQ ID NO: 2454 - RNA, 1353 nt, Artificial Sequence
  KY007221.1 solE CDS opt
agccagaaggugaucuaccuggucaugauucuccugaucgcccccgcuuauuccauuagaugcaucggcguuaacaaucgggacuucguggaggggaugucuggaggcaccuggguggaugucgugcuugaacacgggggauguguuacagugauggcccaagacaaaccuacggucgauauugagcuggugaccacaaccguuagcaacauggcggaagugcgcuccuacugcuaugaggcuucuaucagcgacauggccuccgauucuagauguccgacacagggcgaagccuaccucgacaagcagagcgauacccaguaugucugcaaacggacacugguggaccgcggguggggaaauggcuguggccuuuuugggaagggaucccuggugaccugcgcuaaauucgccuguagcaagaagaugacgggcaaaucuauccaacccgagaaccucgaguacagaauuaugcuguccguccaugggagccagcacucuggaaugaucguuaaugauaccggccaugaaacagacgagaaccgggcuaagguggaaauuaccccuaauagcccccgcgccgaggcgacacucgggggauuuggcucccugggccuggauugcgagccuagaaccgggcuugacuucucugaucuguauuaccucacgaugaacaauaaacacuggcuggugcauaaggaaugguuucacgacaucccccuuccuuggcacgccggagcugacacaggcaccccgcauuggaacaauaaagaggcccuggucgaguucaaggaugcucacgccaagcggcagacagugguugugcucgggucccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaccccguuauuaccgaguccaccgaaaauagcaagaugaugcuggagcuggacccgccuuuuggagauucuuacaucgugaucggcgucggggaaaagaaaauuacacaucacuggcauagauccggcagcaccaucggaaaggcuuucgaggccacagugcggggcgcgaaacgcauggcuguucucggggacacggccugggauuuuggaucu

SEQ ID NO: 2455 - RNA, 1353 nt, Artificial Sequence
  KY003152.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcgccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagc

SEQ ID NO: 2456 - RNA, 1353 nt, Artificial Sequence
  KX694533.2 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauauuggccaugaaaccgacgagaaucgggcuaagguggaaaucacaccuaacagcccccgcgccgaggcgacccucgggggauuuggcucucugggccuggauugcgagccuagaacagggcuugacuucuccgaucuguauuaccucaccaugaauaacaaacacuggcuggugcauaaggaaugguuucacgacauuccccuuccuuggcacgccggagcugacacgggcacaccgcauuggaauaacaaagaggcccuggucgaguucaaggaugcucacgccaagcggcagaccgugguugugcucgggagccaggaaggagcgguccauacagcccuggcuggcgcccuggaagcugagauggacggggccaaaggacgccucuccucuggccaccugaaguguagacuuaaaauggauaagcugcggcucaaaggcgugagcuacucccugugcaccgccgcuuuuaccuucacaaagauccccgcggagacgcuucacgggaccguuacaguggaaguccaauaugccggaaccgacggcccuuguaaagugcccgcucagauggccgucgauaugcagacacugaccccuguggggcgccucauuacggccaaucccguuaucacagagagcaccgaaaacucuaagaugaugcuggagcuggacccgccuuuuggagauuccuacaucgugauuggcgucggggacaagaaaaucacccaucacuggcauagaagcggcucuacaauuggaaaggcuuucgaagccaccgugcggggcgcgaaacgcauggcuguucucggggauacagccugggacuuuggaagc

SEQ ID NO: 2457 - RNA, 1353 nt, Artificial Sequence
  KX601167.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggacaagaaaauuacacaucacugguauagaagcggcucuaccaucggaaaggcuuucgaagccacagugcggggcgcgaaacgcauggcuguucucggggauacggccugggacuuuggaagc

SEQ ID NO: 2458 - RNA, 1353 nt, Artificial Sequence
  KY288905.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggccaugaaaccgacgagaaucgggccaagguggaagugacaccuaacagcccccgcgcugaggccacccucgggggauuuggcucucugggccuggauugcgagccuagaacggggcuugacuucuccgaucuguauuaccucacaaugaauaacaaacacuggcugguccauaaggaaugguuucacgacauuccccuuccuuggcacgcgggagccgacaccggcacaccgcauuggaauaacaaagaggcucugguggaguucaaggaugcccacgcuaagcggcagaccguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcacagccgccuucacguuuaccaaggugcccgcugagacacuucacgggaccgucacaguggaaguccaauaugcgggaaccgacggcccuuguaaagugcccgcccagauggcuguugauaugcagacgcugacaccuguggggcgccucaucaccgccaaucccgucauuaccgaguccacagaaaacagcaagaugaugcuggagcuggacccgccuuucggagauucuuacaucgugauuggcguuggggacaagaaaaucacccaucacuggcauagauccggcagcacaaucggaaaggccuuugaagcuacggugcggggcgccaaacgcauggcgguccucggggauaccgcuugggacuucggaucu

SEQ ID NO: 2459 - RNA, 1353 nt, Artificial Sequence
  KF268950.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccgccuucacauuuacgaaggugcccgcugagacccuucacgggacagucaccguggaaguccaauaugcgggaacagacggcccuuguaaagugcccgcccagauggcuguugauaugcagacccugacgccuguggggcgccucauuacagccaaucccgucaucaccgaguccaccgaaaacagcaagaugaugcuggagcuggacccgccuuucggagauucuuacauugugaucggcguuggggacaagaaaaucacacaucacuggcauagauccggcagcaccauuggaaaggccuuugaagcuacagugcggggcgccaaacgcauggcgguccucggggauacggcuugggacuucggaucu

SEQ ID NO: 2460 - RNA, 1353 nt, Artificial Sequence
  KF383116.1 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccguguguacagccgcuaagguccccgcggagacgcuucacgggaccgugacagucgaagugcaauaugccggaaccgacggcccuugcaaaguucccgcucagauggccguggauaugcagacacugaccccugucgggcgccucauuacggccaaucccgugaucacagaguccaccgaaaacagcaagaugaugcuggagcuggacccgccuuucggagauucuuacauuguuaucggcgugggggacaagaaaaucacccaucacuggcauagauccggcagcacaauuggaaaggcuuuugaagccaccguccggggcgcgaaacgcauggcugugcucggggauacagccugggacuucggaucu

SEQ ID NO: 2461 - RNA, 1335 nt, Artificial Sequence
  KU963574.2 solE CDS opt
agccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacagcggggcggacacggaaacaccgcacuggaauaacaaagaggcccugguggaguucaaggacgcucaugccaagcggcagaccguugugguccucggaucccaggaaggcgcugugcacacagcccuggcgggggcccuggaagcugagauggauggagccaaaggccgccucucuagcgggcaucugaaguguagacuuaaaauggacaagcugcggcucaaaggaguuuccuacagccugugcaccgcugccuuuaccuucacaaaggugcccgccgagacgcuucacggcaccgucacaguggaaguccaauaugcuggccgcgaugggccuuguaaagugcccgcgcagauggccguugacaugcagacccugacaccugugggaagacucaucaccgcuaaucccgucauuacggagucuacagaaaacuccaagaugaugcuggagcuggauccgccuuuuggcgacagcuacaucgugauugggguuggagauaagaaaaucacccaccauuggcaccggucuggcagcaucauugggaaggccuucgaagccaccgugcgcggcgcuaaaagaauggccguccucggagacacagcgugggauuuuggcucc

SEQ ID NO: 2462 - RNA, 1353 nt, Artificial Sequence
  KF383118.1 solE CDS opt
agccagaaggugaucuaccuggucaugauuguucucaucgugcccgccuauuccauuucuugcaucggcgugagcaacagagaccuggucgaggggauguccggaggcaccuggguggauguugugcuugaacacgggggaugugucacagagauggcucaagacaaaccuacgguggauauugaacugguuaccaugacagugucuaauauggccgagguccggagcuacugcuaugaagcgucccucucugacauggcuagcgccucccgcuguccgacccagggcgagcccagccuggauaagcagucugacacacaguccgugugcaaaagaacccuuggggaucggggauggggcaacggcugugggaucuucggaaagggcagccuggugacaugcucuaaauuuaccuguugcaagaagaugccugggaaauccauccaacccgagaaucucgaauaccgcauuaugcugccuguccauggaagccagcacucuggcaugaucguuaacgacauugggcaugagacggaugaaaauagagccaagguggaggugacccccaacuccccucgggcugaggccacacugggaggcuucggcagccucgggcuggacugugaaccgcgcaccggacuugauuuuuccgaccuguauuaccucacaaugaauaacaaacacuggcugguccauaaggagugguuccacgauaucccccuuccuuggcacgcuggcgccgacaccgggacgccccauuggaauaacaaagaagcgcugguggaguuuaaggacgcccacgcuaagagacagacaguugugguccucggaucucaggaaggcgccgugcauaccgcucuggccggggcgcuggaggccgagauggauggagcuaaaggccgccucuucagcggccaccugaagugccggcuuaaaauggacaagcugagacucaaagggguuuccuauagccuguguacagccgcuuuuaccuucaccaaggugccugccgaaacacuucacggaacggucaccguggagguccaaucugccggcacagaugggcccugcaaagugccggcucagauggcgguugacaugcagacccugacaccugugggacggcucauuaccgccaaucccgucaucacggaauccacagagaacagcaagaugaugcuggaacuggauccucccuuuggcgacucuuacauugugaucgggguuggcgauaagaaaaucacccaucacuggcaucgcagcggauccaccauuggcaaggcuuucgaggccacagugagaggggccaaacggauggcuguccucggagacaccgccugggauuuuggcucu

SEQ ID NO: 2463 - RNA, 1353 nt, Artificial Sequence
  KX520666.1 solE CDS opt
agacagaaggugaucuaccuggucaugauucuccugaucgcccccgcuuauagcauucggugcaucggcguuuccaaccgcgacuucguggaggggaugucuggaggcaccuggguggaugucgugcuugaacacgggggauguguuacagugauggcccaagacaaaccuacggucgauauugagcuggugaccacaaccguuagcaauauggcggaagugagauccuacugcuaugaggcuucuaucagcgacauggccuccgauucucgguguccgacacagggcgaagccuaccucgacaagcagagcgauacccaguaugucugcaaacgcacacugguggacagaggguggggaaacggcuguggccuuuuugggaagggaucccuggugaccugcgcuaaauucgccuguagcaagaagaugacgggcaaaucuauccaacccgagaaucucgaguaccggauuaugcuguccguccaugggagccagcacucuggaaugaucguuaacgauaccggccaugaaacagacgagaaucgcgcuaagguggaaauuaccccuaacucccccagagccgaggcgacacucgggggauuuggcagccugggccuggauugcgagccucggaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcgccagacagugguugugcucgggucccaggaaggagcgguccauaccgcccuggcuggcgcccuggaagcugagauggacggggccaaaggaagacucagcuccggccaccugaagugucggcuuaaaauggauaagcugcgccucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggagacucaucacagccaaucccguuauuaccgaguccaccgaaaacagcaagaugaugcuggagcuggacccgccuuuuggagauucuuacaucgugaucggcgucggggaaaagaaaauuacacaucacuggcaucgguccggcagcaccaucggaaaggcuuucgaggccacagugcgcggcgcgaaaagaauggcuguucucggggacacggccugggauuuuggaucu

SEQ ID NO: 2464 - RNA, 1353 nt, Artificial Sequence
  KF383120.1 solE CDS opt
agccagagagugaucuaccuggucaugauucuccugaucgcccccgcuuauuccauucggugcaucggcguuucuaaccgcgacuucguggaggggaugagcggaggcaccuggguggaugucgugcuugaacacgggggauguguuacagugauggcccaagacaagccuacggucgauauugagcuggugaccacaaccguuuccaauauggcggaagugagaucuuacugcuaugaggcuagcaucuccgacauggccucugauagccgguguccgacacagggcgaagccuaccucgacaaacaguccgauacccaguaugucugcaagcgcacacugguggacagaggguggggaaacggcuguggccuuuuugggaaaggaagccuggugaccugcgcuaaguucacguguucuaaaaagaugaccggcaaguccauccaacccgagaaucucgaguaccggauuaugcugagcguccaugggucucagcacuccggaaugaucguuaacgauauuggccaugaaacagacgagaaucgcgccaaaguggaagugaccccuaacagccccagagcugaggccacacucgggggauuuggcucucugggccuggauugcgagccucggaccgggcuugacuucuccgaucuguauuaccucacgaugaauaacaagcacuggcugguccauaaagaaugguuucacgacaucccccuuccuuggcacgcgggagccgacacaggcaccccgcauuggaauaacaaggaggcucugguggaguucaaagaugcccacgcuaagcgccagacaguugugguccucgggagccaggaaggagccgugcauaccgcgcuggccggcgcucuggaagccgagauggacggggcuaagggaagacucuuuuccggccaccugaaaugucggauuaagauggauaaacuucgccugaagggcguuucuuacagccucugcaccgccgccuucacauuuuccaaagugcccgcugagacgcugcacgggaccgucacaguggaaguccaauaugcgggaagagacggcccuuguaaggugcccgcccagauggcuguugauaugcagacccuuacaccuguggggcggcugaucaccgccaaucccauuaucacggagagcacagaaaacucucgcaugaugcucgagcuggacccgccuuucggagauuccuacaucgucauuggcgugggggacaaaaagaucacccaucacuggcauagaagcggcucuaccauuggaaaggccuuugaagcuacaguucggggcgccaaaagaauggcggugcugggggauaccgcuugggacuucggaagc

SEQ ID NO: 2465 - RNA, 2136 nt, Artificial Sequence
  ZIKV (strain ZikaSPH2015) Polyprotein(93-804) CDS opt
aggauaauaaaugccagaaaggaaaaaaaaagaagaggagcugauacaaguguaggaauaguaggauuauuauugacaacagcaauggcagcugaaguaacgagaagagguucagcauauuauauguacuuagacaggaaugaugcaggugaagcaauaucauucccaacaacacuaggaaugaauaaauguuauauacaaauuauggaccucggacauaugugugaugcuacgaugucauaugaaugcccuaugcuggacgagggaguugaaccagaugauguugauuguuggugcaacacaacaaguacaugggucguauauggaacaugucaucauaaaaaaggagaagcacgaaggaguagaagagcuguaacauuaccaucacauucaacgcgaaagcuacaaacgcgaucacaaacaugguuagaaagcagagaauacaccaaacaucuaauuagaguagagaauuggauuuuuagaaauccaggauuugcacuggcggccgcugcaauugcauggcuauuaggaaguucaaccagucaaaaaguaauauaccuaguaaugauauuacuaauagcgccagcuuauagcauaagaugcauaggaguuaguaaccgagauuuugucgagggaaugucaggugguacuuggguagacauagugcuagaacaugguggauguguaacaguuauggcacaggacaaaccaacaguagacauugaacucguaacaacaacuguaaguaauauggcagaaguacggucauacuguuaugaagcuaguauaucagauauggcaagcgacagcagaugcccaacucaaggggaagcauacuuagauaaacaaagugauacucaguauguauguaaacgaacauuaguagacagaggauggggaaacggauguggacuuuucgguaaagguagccuagugacaugugcaaaauuugcuuguaguaaaaaaaugacuggaaaaucaauacaacccgaaaaucuagaauauagaauaauguugucaguccacggaucacagcauucugguaugauuguaaaugauacuggacaugaaacagaugaaaauagagcaaaaguagaaauaacaccaaacaguccaagggcagaagcaacauuaggugguuuuggaucacuaggguuagauugugaaccaaggacgggauuagauuuuagcgacuuauacuauuuaaccaugaacaauaaacacugguuaguacacaaagaaugguuucacgauauaccguugccguggcaugcgggagcugauacaggcacaccacauuggaauaauaaagaagcccuaguagaauucaaagacgcacacgcgaaaagacaaacaguaguaguauuagguucgcaagaaggcgcagugcauaccgcauuggcaggugcauuggaagcagaaauggauggagcaaaaggaagguuaaguucuggacauuugaaauguagauugaaaauggauaaacuaagacuaaaaggagugagcuauucauuauguaccgcagcauuuacauucacaaaaauuccagcagaaacguuacacggaacaguuacgguagaaguacaauaugcagggacagauggccccuguaaaguaccagcucaaauggcgguugauaugcaaacccuaaccccagugggaagauuaauuacagcuaacccaguaauaacagaaaguaccgaaaauagcaaaaugaugcuugaacuagacccaccauuuggagauucauacauaguaauaggaguuggagaaaaaaagauaacacaucauuggcauaggaguggaaguacuaucggaaaagcguuugaagcgacaguuagaggagcaaaaagaauggcuguguuaggggauacagcaugggauuuuggaagcgucggaggagccuuaaauucuuuaggaaaaggaauucaucaaauauuuggggccgcauucaaaagucuauuugguggaaugucaugguuuucacaaauauuaauaggaacauuguuaauguggcuaggauuaaacacuaaaaacggaagcauaucacuaaugugucuagcuuuggguggaguacuaauauuucuauccacugcuguaucagcagacgugggguguagcguggacuucaguaaa

SEQ ID NO: 2466 - RNA, 2136 nt, Artificial Sequence
  ZIKV (isolate Z1106033) Polyprotein(93-804) CDS opt
agaauaaucaaugcgaggaaagaaaagaaaagaagaggagccgacacuagcgucgguauaguagguuuauuauuaacaacugccauggccgccgaaguuacaagaagagguucagcauacuacauguauuuagauagaaaugaugcaggagaagcuauuuccuuuccuacaacucuuggaaugaauaaauguuauauccaaauuauggaucuaggacauacgugcgaugcaacaaugagcuacgaauguccaauguuagaugaaggaguagaaccagaugacguugauugcugguguaacacaacuucaacauggguaguuuauggcacaugucaucauaagaaaggagaagcaagaagaaguagacgugcaguaacauuaccaagucauucaacuagaaaacuacaaacuaggagccaaacauggcuugaaaguagagaguauacaaaacaccuuauuagaguagaaaauuggauauuuaggaauccaggauucgcguuagcagcagcugcaauagcaugguugcuaggaagcucaacaagucaaaaaguaauauauuuaguaaugauacuucuaauagcaccagcauauucaauaagauguaucggaguaucaaaccgagauuuugucgaaggaaugucuggugguacauggguagacguaguauuagagcacggaggauguguaacaguaauggcacaagauaaaccaacaguggauauagaauuggucacaacaaccguaucaaauauggcugaagucagaagcuacugcuaugaagcaucgauaagugauauggcgagugacucuagaugcccaacccaaggagaagcauacuuagauaaacaaucagacacacaauacguauguaaaagaacuuuaguagauagagguuggggcaacggauguggacucuuuggaaaaggaucgcuaguuacaugugcaaaauuugccuguucaaagaaaaugacgggaaaaucaauacagccagaaaauuuagaauauagaauaauguugaguguacauggaucccaacauucaggaaugauaguaaaugauacaggacaugaaacugacgaaaauagagcaaaaguugaaauaacaccaaauucaccacgugcagaggcgacacucggugguuucgggucauugggucuugauugugaaccaagaacaggauuagauuuuucagauuuauauuacuuaacaaugaacaauaaacacugguuaguacauaaagaaugguuucaugauauaccguuaccauggcaugcaggagcagauacaggcacaccacauuggaauaauaaagaagcauuaguugaguucaaagaugcgcacgcuaaaagacaaacaguugucguauuagguagucaagaaggagcaguacauacagcgcuagcuggagcacuagaagcugaaauggauggagcaaaaggaagacuaaguaguggucauuuaaaauguagauuaaaaauggacaaacuuagguuaaaaggaguuaguuacucauuauguacugcggcuuuuacauuuacaaaaauaccugcagaaacauuacacgguacaguuacagucgaaguacaauaugcugguacagacggaccuuguaaaguaccagcucaaauggcaguagauaugcaaacacuaacaccaguuggacgccuaauaaccgcaaauccuguuauaacagaaucuacggaaaacucaaaaaugauguuagaauuagaucccccauuuggggauucauauauaguaauugggguaggagaaaagaaaauaacacaucacuggcacagaaguggaaguacaauaggaaaagcauucgaagcaacaguaagaggagcaaaaagaauggcaguccuaggggacacugcaugggauuucggaagcguaggaggggcuuuaaauagucucgggaaaggaauccaucaaaucuuuggagcagcguuuaaaucacuauuuggaggaaugucaugguuuucacaaauauuaauagguacuuuacuaaugugguuaggacuaaaugcuaaaaacggcucaauuucauuaauguguuuagcauuaggaggaguuuugauauucuuaucaacagcaguuagcgcugacguuggauguaguguagauuuuagcaaa

SEQ ID NO: 2467 - RNA, 2124 nt, Artificial Sequence
  ZIKV (strain MR 766) Polyprotein(93-800) CDS opt
cgaauaauaaacgcgagaaaagaacguaaacgucgaggagcagacacaagcauaggcauaauaggauuacugcuaacaaccgcaauggcagccgaaauaacaagaagaggaucagccuauuauauguaucuagauagaagugaugcagguaaagccauaucauuugcaaccacguuaggaguaaauaaaugccauguacaaauaauggaccuuggacauaugugcgaugcaacaaugucuuaugaauguccuaugcuagaugaaggaguagaaccagaugacguugauuguugguguaauacaacuuccacauggguagucuacggaacaugccaucacaaaaaaggugaagcuaggaggucaagacgagccguaacauuaccaucucauucaacaagaaaauuacaaacaagaucacaaacauggcuagaaucaagggaauauacaaaacaucuuauaaaaguagaaaauuggauuuucagaaauccugguuuugcacuaguagcaguagcaauagccuggcucuuagguagcaguaccagccaaaaaguaauauaucucgucaugauucuauuaauagcuccagccuacagcauaagauguauuggaguaucaaauagagauuuuguagaagguaugucuggaggaacauggguugauguaguuuuagaacaugggggauguguaacaguaauggcacaagauaaaccaacaguggacauugaauuagucaccacaacuguaucuaauauggcagagguacgaucauauuguuaugaagcaagcauaagcgauauggcgagugauucaagaugccccacacaaggagaagcuuauuuagauaaacaaagugauacacaguauguaugcaaaagaacccuaguggauagagguugggguaaugguugcggauuauuuggaaaaggaagucuaguaacaugugcaaaauucacuuguucaaaaaaaaugacagggaaaaguauacaaccagaaaauuuagaauauagaauaauguuaagcguacaugguucacaacauucgggaaugauaggauaugaaacagaugaagauagggccaaaguagaaguaacaccaaacaguccaagagcagaagccacacuuggugguuucggaucucucggauuagacugugaaccucgaacagggcuugacuuuucagaucuauacuauuuaacaaugaauaauaagcauuggcuaguucacaaagaaugguuucacgauauuccgcuuccauggcaugcgggagcagauacaggaacuccacauuggaauaauaaagaagcacuaguugaauucaaagaugcacaugcaaaaagacaaacagucguaguuuuaggaucacaagaaggagcaguacauacagcacuagccggagcuuuagaagcagaaauggauggugcaaaaggacgacuauuuagcggacaccuaaaaugucgucuaaaaauggauaaacuuagauuaaaaggaguaucguacucguuauguacagcagcauuuacauuuacuaaagugcccgcagaaacacuacauggaacagugacuguugaaguacaauaugcaggaacagauggcccauguaaaauuccuguucaaauggcaguugauaugcaaacauuaacuccaguuggaagacuaauaacagcaaacccuguuauaacagaaucaacugaaaauaguaaaaugauguuggaacuggacccaccauucggagauaguuacauaguaauagguguaggagauaagaaaauaacacaucauuggcacagaucagguaguaccauugguaaagcauucgaagcaacaguuagaggagcaaaaagaauggcaguucucggagauacagcaugggauuuugguagugugggagguguuuuuaacaguuuagguaaaggaauacaucaaaucuuuggugcagcuuuuaaaagccuauuuggaggaaugucaugguucucucaaauucuaauagguacacuauuaguuuggcuaggacuuaauacgaaaaaugggucuauuaguuuaacuuguuuagcacucggaggaguaaugauauucuuaaguacagcaguauccgcugacgucgguuguucaguagauuucucaaaa

SEQ ID NO: 2468 - RNA, 2136 nt, Artificial Sequence
  ZIKV (strain NatalRGN) Polyprotein(93-804) CDS opt
agaauaauaaaugcaaggaaagaaaagaaaagaagaggagcagacacaagcguagguauaguaggguuauuauuaacaacugcuauggcugcugaaguaacaaggagggguagugcauauuauauguauuuagacagaaacgaugcaggggaagcaauaaguuuuccuacaacauuaggaaugaauaaauguuauauccaaauuauggacuuaggccauaugugugacgcuacaaugaguuacgaauguccaauguuagaugaagguguagaaccagacgauguggauuguugguguaacacaacaucaacauggguaguauaugguacaugucaucauaagaaaggagaagcaagaagaucaaggagagcuguaacucuaccuucacacagcacaagaaaauuacaaacuagaucacagaccugguuagaaucuagagaauauacaaaacauuuaaucagaguagaaaauuggaucuucagaaaccccggguuugcucucgcagcagcagcaauagcaugguuacuuggaaguucuacaucacaaaaaguuauuuaccuaguaaugauucuacuaauagcaccagcuuauagcauaagaugcauuggaguuaguaacagagacuuuguagaaggaaugucaggugguacuugggucgaugugguauuagaacaugggggaugcguaacuguuauggcacaagacaaaccaacaguagauaucgagcuaguaacaacaacgguaagcaacauggcagaagugagaaguuauuguuaugaagcaagcauaagugauauggcauccgauucacgauguccaacacaaggugaagcauaccuagauaaacaaucagauacacaauauguauguaaaagaacauuaguugauagggguuggggaaauggauguggacuauucggaaaagggucauuagugacgugugcaaaauuugccugcaguaagaaaaugacugggaaaagcauucaaccagaaaaucuagaauauagaauaaugcuaaguguacauggaucucaacauaguggcaugauaguaaacgauacaggacacgaaacugacgaaaacagagcuaaaguagaaaucacucccaauagcccaagagcugaagcaacacuaggaggauuuggaucauuaggacuugacugugaaccuagaacaggauuggacuuuagcgaucuauacuaucuaacaaugaauaauaaacauuggcuaguacauaaagaaugguuucaugauauuccacuuccauggcacgccggcgcagacacagggaccccucacuggaacaauaaagaagcauuaguagaguucaaagaugcucaugcaaaaagacaaacaguaguuguauuagguucgcaagaaggagccguacauacugcacuugcaggagcuuuagaagcagaaauggauggagcaaaaggacgauuaucuaguggacaucuaaaauguagacuaaaaauggacaaauuaagauuaaaaggaguaagcuauucauuauguacagcagcauuuacauucacaaaaauaccugcugaaacccuacacggcacaguaacaguagaaguucaauaugcaggaacugauggaccuugcaaaguacccgcacaaauggcaguugauaugcaaaccuuaaccccuguuggcagacuaaucacagcaaacccaguuauaacagaaucaacagaaaauagcaaaaugaugcuagaacuggauccaccuuucggugauucauauauaguaauaggaguaggggaaaagaaaauuacucaucacuggcauagaucaggaucaacaaucgguaaagcauucgaagcuacaguacgaggggcaaaaagaauggcaguacuaggagauacugcaugggauuuugguaguguagguggagcacuaaauuccuugggaaaaggaauacaccaaauauuuggagcugcauuuaaaagucuauuuggaggaaugagcugguuuagccagauucuaauuggaacauuacuuauguggcucggauuaaacacaaagaauggaaguauuucauuaauguguuuagcucucgguggcguauuaauauuuuuaaguacagcaguuagcgcagacguuggauguucaguagauuuuaguaaa

SEQ ID NO: 2469 - RNA, 2061 nt, Artificial Sequence
  ZIKV (strain ZikaSPH2015) Polyprotein(108-794) CDS opt
acaagcguaggaauuguuggacuauugcuaacaacugcaauggcugcagagguaacucgaagaggcagcgcauacuacauguauuuggauagaaaugacgcaggggaagcaauaagcuuuccaacgacauuaggaaugaauaaauguuauauacaaauaauggauuuaggacacaugugugaugcaacuaugaguuaugagugcccaaugcuugaugaaggagucgaaccagaugauguugauuguugguguaauaccacaaguacauggguugucuacggaacaugucaccauaaaaaaggugaagcuagaagaaguagaagagcaguaacacuacccagucacucaacuagaaaacuacaaaccagaucccaaacaugguuagaaaguagggaauacacaaaacaucuaauuagaguugaaaacuggauauuuagaaauccagguuucgcuuuagcagcagcagcaauugcuugguuauuaggaaguucaacaucacagaaaguuauauaccuaguaaugauacuacuaauugcacccgcauauaguauacgauguauuggaguuagcaaucgugauuucguugaaggaaugucaggaggaacuuggguugacauaguauuagaacauggaggguguguaacgguuauggcacaagauaaaccaacgguugauauagagcuaguaacaacaacaguuagcaauauggcagaaguacgaucauauugcuaugaagcuucaauaucagauauggcaucagauucgagauguccaacacaaggggaagcauauuuagauaaacaaagugauacacaauauguauguaaacgaacacuaguagauagagguugggggaauggaugugguuuauucggaaaaggaucacuuguaacaugugcaaaguuugcauguucaaaaaaaaugacaggcaaaagcauacaaccagaaaaucuagaauacagaaucauguuaucaguacauggaucucaacauagcggaaugauaguuaaugacacaggacaugaaacagaugaaaauagagcgaaaguagagauaacaccuaauaguccaagagcagaagcaacauugggaggauucggaucucuaggacuagauugugaaccacgaacaggacuugacuuuucugauuuauacuaucuaacaaugaacaauaaacacuggcuaguacauaaagaaugguuucacgauauaccacuaccauggcacgccggagcagauaccggaacaccacauuggaauaauaaagaagcauuaguagaauuuaaagaugcccaugcuaaaagacaaacaguuguagugcuuggaagucaagaaggagcaguacauacagcauuggcuggugcauuagaagcagaaauggauggugcaaaaggaaggcuaaguucuggacaucuaaaauguaggcuaaaaauggauaaauuaagauuaaaaggaguaucauauucauuauguaccgcugccuucacuuuuacaaaaauaccagcagaaacgcugcacggaacuguaacaguugaaguacaauaugcuggaacagauggaccaugcaaaguuccugcacaaauggcuguagacaugcaaacacugacuccuguugggagacuaauuacagcaaaccccguaauaacagaaaguaccgaaaacucuaaaaugauguuagaauuagauccaccuuucggggauaguuauauaguaauaggaguaggggaaaaaaaaauaacucaucacuggcauaggagcggcaguacuauagguaaagccuuugaagcaacugucagaggugcaaaaagaauggcaguguuaggugacacagcaugggauuucggaucaguaggaggugcauuaaauaguuuaggcaaaggcauucaucaaauauuuggggccgcauucaaaagucuguucggaggaaugagcugguucagucagauauuaauaggaacacuauuaauguggcuaggucuaaacacaaaaaacgggaguauuagucucaugugucuugcauuaggaggaguauuaauauuuuuaaguacagcagucucagca

SEQ ID NO: 2470 - RNA, 2061 nt, Artificial Sequence
  ZIKV (isolate Z1106033) Polyprotein(108-794) CDS opt
accucaguagguauaguagguuuacuauuaacaaccgcaauggcagcagaagugacaagaagaggaucagcauacuauauguauuuagauagaaaugaugcaggagaggcaauuucauucccaacaaccuuaggaaugaacaaauguuauauacaaauaauggauuuaggacauacaugugacgcaacaaugaguuacgaauguccaaugcuagacgaagguguagaaccagaugacguagacugcugguguaauacaacaucaacauggguuguuuacggaaccugucaucauaagaaaggugaagcaagaagaaguagacgagccguaacucuaccaucacacucaaccagaaaacuccaaacaagaagucagacauggcuugaaagccgagaauacacuaaacauuuaauaagaguugaaaauuggauuuuuagaaacccaggauucgcauuagcagcagcagcaauagcgugguuacuagguucaucaacgucacaaaaaguuauuuauuuagucaugauucuguuaauagcaccagcuuacaguauaagauguaucggaguaucaaauagggacuuuguugaaggaauguccggagguacuuggguagauguaguauuagaacauggaggauguguaacaguaauggcacaagacaaaccaaccguagauauagagcuaguaacuacuacaguauccaauauggcagaaguacguaguuauuguuaugaagccagcauaagugauauggcaucagauucaagaugcccaacacaaggugaagcauauuuagauaaacaaagugacacacaauacguauguaaaagaacauuaguagacagaggauggggaaaugguuguggauuauucgggaagggaucacuuguaacuugugccaaauucgcaugcucaaagaaaaugacagggaaaucgauacaaccagaaaauuuagaauacagaauaaugcucaguguacauggaagccaacauucaggaaugaucguuaaugauacuggucaugaaacagacgaaaacagagccaaaguugaaauaacaccuaauucaccaagagcugaagcaacauuaggaggauucggaucauuaggucuagacugugaaccaagaacaggucuagacuuuagcgauuuauauuaccuaacuaugaauaauaaacauuggcuaguucauaaagaaugguuucaugauauaccacucccuuggcaugcaggagcagacacaggaacaccacauuggaauaauaaagaagccuuaguagaauuuaaagaugcacaugcuaaaagacagacaguuguuguacucggaucucaagaaggagcaguacauacagcauuagcaggagcauuagaagcagaaauggauggugcaaaagguagauuaucuaguggucaccuuaaaugucgauuaaaaauggauaaauuaagauuaaaagggguuucauauagucuuugcacugcugcguuuacauuuacuaaaauaccagcagaaacucuacacggcacaguaacuguagaaguacaauaugcuggaacugacggccccuguaaaguaccagcgcaaauggcugucgauaugcaaacccuaacacccguaggaaggcugauaacagcaaauccuguaauaacagaaaguacggaaaauucaaaaaugauguuagaacuagauccaccauucggcgauucauacauaguaauuggaguaggagaaaagaaaauaacccaccauuggcauaggagcggaagcacaauaggaaaagcauucgaagcaacaguaagaggugcaaaaagaauggcaguacuaggagauacagcuugggacuuuggauccguugguggagcauuaaauucguuagguaaaggaauacaccaaauuuucggagcagcuuucaaaucccuauuuggaggaaugucaugguuuucccaaaucuuaauaggaacacuauuaauguggcuaggccuaaaugcuaaaaauggaucuauaucauuaaugugcuuagcacuaggcggcguucugauauuuuuaagcacugcaguaucagca

SEQ ID NO: 2471 - RNA, 2049 nt, Artificial Sequence
  ZIKV (strain MR 766) Polyprotein(108-790) CDS opt
acaaguauaggaaucauuggauuacuacuaacaacugcaauggcagcagaaauaacuagacgaggaucagcauauuacauguauuuagauagauccgaugcuggcaaagcaauuucauuugcaacaacacuaggaguaaacaaaugucauguucaaauaauggaucuaggacauaugugugaugccacaaugucguaugaguguccaauguuagaugaagguguagaaccagacgauguagauugcugguguaauacgacauccacauggguaguauauggaacuugucaucacaagaaaggagaggcaagacgcuccaggagagcaguuacauuaccaagucauaguacaagaaaauuacaaacaagaagccaaacuuggcuugaaucgagagaauauacaaaacauuuaauuaaaguagaaaauuggauauuuagaaacccaggauucgcauuaguggcagucgcaauugccuggcuauuagggagcaguacaucacaaaaaguaauauaucucguaaugauacuauuaauagcuccugcauacagcauaagaugcauaggaguuucaaaccgagauuuuguagaagguaugagcggaggcacauggguagacguuguacuagaacauggaggaugugucacugugauggcacaagacaaaccaacaguagauaucgaacugguaacaacaacaguaaguaauauggcagaaguaagauccuauugcuaugaagcaucgauaucagacauggcaagugauucuagaugcccaacucaaggagaagcauauuuagauaaacaaagcgacacacaauauguaugcaagaggacucuaguagauagagguugggguaauggauguggcuuauuuggaaaaggaagucucguaacaugcgcaaaguucacauguucaaagaaaaugacuggaaaaucuauacaaccagaaaauuuagaguauagaauaaugcucagcguacaugguucacaacacaguggaaugaucggauacgaaacugacgaagaccgagcaaaaguugaaguaaccccuaauucaccaagagcagaagcaacauuaggaggguucggaagccucggauuagacugcgaaccacgaacaggauuagauuuuucagaucuauacuauuuaacaaugaacaacaaacauugguuaguucauaaagaaugguuucaugauauaccacuaccauggcaugcaggcgcugauacaggcacuccacauuggaauaacaaagaagcauuaguagaauuuaaagacgcacacgcaaaacgacaaacaguaguaguuuuaggaagccaagaaggagcgguacacacugcauuagccggugcauuagaagcagaaauggauggugcaaaaggaagacuauuuucuggucauuuaaaaugucgauuaaaaauggauaaauuaagacucaaaggaguaucuuacaguuuauguacagcagcauucacauucacaaaaguaccugcagaaacauuacauggaacgguuacaguagaagugcaauaugcuggaacagauggaccauguaaaauaccagugcaaauggcuguagauaugcagacuuuaacaccagucggaagauuaauaaccgcaaauccaguaauaacagaaaguaccgaaaauucaaaaaugauguuagaauuagauccaccauuuggcgacaguuauauuguuauaggaguaggcgauaagaaaauaacacaucacuggcauagaagcggaucuacaauaggaaaagccuuugaagcaacaguaagaggagccaaaagaauggcaguacucggugauacagcuugggauuucggaucuguuggaggaguuuucaauucauuaggcaaaggaauacaucaaauauucggagcugccuuuaaaucauuauuugguggaaugucaugguuuucucaaauucuaauagguacauuacuuguauggcuaggacuaaacacuaaaaaugguucaauaucacuaacaugucuagcuuuaggcggaguaaugaucuucuuaagcacagcuguaucagca

SEQ ID NO: 2472 - RNA, 2061 nt, Artificial Sequence
  ZIKV (strain NatalRGN) Polyprotein(108-794) CDS opt
acaucaguaggaauagucggacuuuuguuaacgacagccauggcagcugaaguaacaagaagaggcucugcauacuauauguaucuagaccggaacgacgccggagaagcaauaucauucccaacaacauuaggcaugaauaaaugcuacauacaaauuauggaucuuggacauaugugcgaugcaacaaugucuuaugaauguccaauguuggaugaaggaguugaaccugacgauguagacugcuggugcaacacaacaucaacauggguuguauaugguaccugucaucauaaaaaaggcgaagccagaagaucaagaagggcaguaacacugccuagucauaguacuagaaaauuacaaacuagaucacaaacuugguuagaaucaagggaauacacaaaacaccuaauacgaguagaaaauuggauauuucgaaauccaggguucgcacuagcagcagcugcaauagcauggcuuuuaggaaguucaacaagccaaaaagucauauaucuaguuaugauucuacuuauagcaccugcauacucaauacgaugcauaggagucucaaauagggauuuuguagaagguaugucaggagggaccuggguagacguaguacuagaacaugguggauguguaacagucauggcacaagauaaaccaacaguagacauagaauuaguaacaacgacugucuccaauauggccgaaguuagaucauacugcuacgaagcuucuauaucagauauggcaagcgauucaagaugucccacccaaggugaagcauaucuagacaaacaaucagauacacaauacguuuguaaaagaacauuaguagacagagguuggggaaauggauguggauuauuuggaaaagguaguuuaguaacaugcgcaaaauuugcuugcagcaaaaaaaugacaggaaaauccauacaaccagaaaaccuugaguauagaauaaugcucaguguucauggaucacaacauucuggaaugauaguaaaugacacaggacacgaaacugacgagaaucgugcuaaaguagaaauaaccccaaauaguccuagagcagaagcaacauuaggcggauuuggaaguuuaggauuagauugugaaccaagaacaggcuuggauuuuagugaucuauauuacuuaacaaugaauaacaaacauugguugguccauaaagaaugguuccaugauauaccauuaccauggcacgcuggagcagauacuggaacaccgcauuggaauaauaaagaagcacuuguugaauucaaagacgcucaugcuaaacgacaaacaguaguuguacucggaagccaagaaggcgcaguccacacagcucuagcaggagcguuagaagcugaaauggauggcgcaaagggaagauuaagcucaggacaccuaaaaugcagacuuaaaauggacaaacuaagauuaaaaggaguuaguuauagccuauguacagcagcauucacauuuacuaaaauaccagcugaaacauuacauggaacuguuacaguagaaguacaauaugcaggaacagaugguccauguaaaguaccugcacaaauggcaguagauaugcaaacauuaacaccugucggaagauuaauuacagcaaauccuguaauaacggaaaguaccgaaaauucaaaaaugaugcuagaauuagacccaccuuuuggcgauagcuacauaguaauuggaguaggagaaaaaaaaauaacacaucauuggcaccgaaguggaagcacaauaggaaaagcauuugaagcaacaguuagaggagcaaaaagaauggcaguauuaggggauaccgccugggauuucgguucuguaggaggugcacuaaauagucuuggaaaaggcauacaccaaauuuuuggagcagcuuucaaaucacuguuugguggaaugaguugguuuucacaaauucuaauaggaacauuauuaaugugguuaggauuaaauacaaaaaacggaucaauaagcuuaaugugucuagccuuaggaggcguauuaauauuccuaucgacagccguaagugca

SEQ ID NO: 2473 - RNA, 1353 nt, Artificial Sequence
  ZIKV (strain ZikaSPH2015) Polyprotein(273-723) CDS opt
agucaaaaaguaauauaucuagucaugauauuauuaauagcaccagcauauucaauaagauguauaggagucucaaacagggauuucguagaaggaaugaguggagguacguggguagauauaguuuuagaacauggaggauguguaaccguuauggcacaagacaaaccaacaguagacauagaguuagucacaacaacaguaagcaauauggcagaaguaagaucauacuguuaugaagcaaguauaagugauauggcaagugacucaagauguccaacucagggagaagcauaccuagacaaacaaucagacacacaauacguauguaaacgaacacuaguggauagaggauggggaaaugguuguggacuauuuggaaaaggaagccugguuacaugcgcuaaauuugccugcucaaaaaaaaugacaggaaaaucaauacaaccagaaaaucuagaauaucggauuauguuaagcguacauggaagccaacacucaggaaugauaguaaaugauacaggacaugaaacagaugaaaaucgagcaaaaguggaaauaaccccaaacagcccaagagcagaagcuacacuaggaggauuuggauccuuaggacuagauugugaacccagaacaggacuagacuuuucugauuuauacuaucuuacaaugaauaauaaacauugguuaguacacaaagaaugguuccaugauauaccauuaccauggcaugcaggagcagauacgggcacaccacacuggaauaauaaagaagcauuaguagaauuuaaagaugcacacgcaaaaagacaaacaguaguaguauuaggaucacaagaaggcgcaguucauacagcccuagcaggagcacuagaagcagaaauggauggagcaaaaggaaggcuuagcagcggucauuuaaaaugcagauuaaaaauggauaaauuaagacuaaaaggaguaaguuauagucuauguacagccgcauuuacauuuacaaaaauaccagccgaaacuuuacauggaacaguaacaguagagguacaauaugcaggaacggacggaccauguaaaguaccagcacaaauggcuguagacaugcaaacacuaaccccaguaggcagauuaauaacagcuaauccaguuauaacagaaaguacagaaaauucuaaaaugaugcuagaauuagacccaccuuuuggagacucauauauaguaauagguguaggagaaaaaaaaauaacacaucauuggcauagaucaggaaguacaauaggaaaagcauucgaagcaaccguaagaggagccaaaagaauggcgguacuaggugauacagcaugggauuuuggcuca

SEQ ID NO: 2474 - RNA, 1353 nt, Artificial Sequence
  ZIKV (isolate Z1106033) Polyprotein(273-723) CDS opt
agucaaaaaguuauauauuuaguuaugauuuuacuuauagcuccggcauacaguauaagauguauaggaguaucaaauagagauuucguagagggaaugaguggaggaacauggguagauguaguauuagaacauggagguuguguaacaguaauggcacaagacaaaccaacaguagauauagaauuaguuacaaccacaguaucaaauauggcagaaguaagaagcuauugcuaugaagcaaguauaagugacauggcaagugauagcagauguccaacacaaggagaagcauauuuagauaaacaaagugauacacaauacguuuguaaaagaacauuaguagauagagguuggggaaacggaugugguuuauuuggaaaagggucuuuaguaacuugugcgaaauuugcuugcaguaaaaaaaugacaggaaaaucaauacaaccagaaaauuuagaauauaggauaauguuaucaguacauggaucucaacauagcgguaugauaguaaaugacacaggacaugaaacagaugaaaauagagcaaaaguagaaauaacaccgaauucgcccagagcagaagcaacacugggaggauuuggaagccuaggacuagauugugaaccaagaacgggacuagauuuuucagaucuguauuaucuuacaaugaauaauaaacauuggcuagugcauaaagagugguuucaugauauaccacuaccauggcaugcaggagcagacacagguacaccacauuggaauaauaaagaagcacuaguagaauucaaagacgcacaugcaaaaagacaaacaguuguuguacuaggaagccaagaaggagcaguacauacagcauuagcaggggcauuagaagcagaaauggacggagcaaaagguagacuaucgagcggacaccuaaaauguagauuaaaaauggauaaacuacgauuaaaaggaguaaguuacaguuuaugcacagcugcauuuacauuuacaaaaauaccggcagaaacauuacauggaacgguuacaguagaaguacaauacgcuggaacagauggacccuguaaagugccugcgcaaauggcaguggacaugcaaacauugacaccaguaggaagacuaauaacagcaaauccaguaauaacagaaaguacggaaaauaguaaaaugauguuagaacuagauccuccauuuggagacucauauauaguaauaggaguaggagaaaaaaaaaucacacaccacuggcacagaucaggaucgacaauaggaaaagccuuugaagcaacaguaagaggagcaaaaagaauggcuguauuaggggacacagcaugggacuuuggaagu

SEQ ID NO: 2475 - RNA, 1341 nt, Artificial Sequence
  ZIKV (strain MR 766) Polyprotein(273-719) CDS opt
ucacaaaaaguaauuuaucuaguuaugauauuauuaauagcuccagcauacaguauaagauguauaggaguaucaaacagagacuuuguagaaggaaugucaggaggaacauggguugacguaguauuagaacacgguggaugcguaacaguaauggcacaggacaaaccaacaguugauauagaauuaguuacaacaacaguuucaaauauggcugaaguaagaucauauuguuaugaagcaaguauaagugacauggccagcgacaguagaugcccuacacaaggagaagcauaccuagauaaacaaagcgauacacaauacgucugcaaaagaacccuaguagacagagguuggggcaacgguuguggacuauuugguaaagguagcuugguaacaugugcaaaauuuacauguucaaagaaaaugacaggaaaaucaauacaacccgaaaaucuugaauauagaauaaugcugaguguacauggaagucaacauucaggaaugaucggauacgaaacagacgaagauagagcaaaaguagaaguaacaccaaauucaccgagagcagaagcaacacuaggaggauuuggcucacuaggauuagacugugaaccaagaacaggacuagauuucagugaucuauacuaccuaacaaugaacaacaaacacugguuaguacauaaagaaugguuucaugacauaccauuaccuuggcacgcaggagcagauacaggaacaccacauuggaauaauaaagaagcauuaguggaauuuaaagaugcucaugcaaaaagacaaacaguaguaguacuaggaagucaagaaggcgccguacacacagcucuagcaggagcauuagaagcagaaauggauggagcaaaaggaagauuauuuaguggacacuuaaaauguagauuaaaaauggauaaacuaagauuaaaagguguaucauauaguuuauguacagcagcuuucacauuuacaaaaguaccagcagaaacauuacauggaacagucacaguagaaguacaauacgcaggaacagauggaccauguaaaauaccaguacaaauggcaguagacaugcaaacacuaacuccaguaggaagguuaauaacagcaaauccaguaauaacagaaaguacagaaaauaguaaaaugauguuagaauuagaucccccauuuggagacaguuauauagugauaggcguaggagacaagaaaauaacacaucauuggcauagaucagguucaacuauaggaaaagcauuugaagcuacaguaagaggugcgaaaagaauggcaguacuaggagauacagcaugggacuuuggaagu

SEQ ID NO: 2476 - RNA, 1353 nt, Artificial Sequence
  ZIKV (strain NatalRGN) Polyprotein(273-723) CDS opt
agucaaaaaguuauauauuugguaaugauauuacuaauugcuccagcauauucaauacgaugcauaggaguaucaaauagagauuucgucgaaggaaugaguggaggaacauggguagauguaguauuagaacauggaggaugcguaacaguaauggcacaagauaaaccaacaguagauauagaacuaguaacaacaaccguaucaaacauggcagaaguaagaucauauuguuaugaagcaucaauaagcgacauggcgucugauaguagaugcccaacacaaggugaggcauauuuagauaaacaaagcgauacacaauauguuugcaaaagaacauuagucgauagaggauggggaaauggauguggauuguucggaaaaggaucacuagucacaugugcaaaguuugcauguaguaaaaaaaugacaggaaaaaguauccaaccagaaaacuuagaauauagaauaaugcucaguguacaugguagucaacauaguggcaugauagugaaugauacaggucaugaaacagaugaaaaucgagcgaaaguagaaauuacacccaauucuccuagagcagaagcaacuuuaggaggauuuggaaguuuaggauuagauugcgaaccaagaacaggauuagacuucagcgaucuauacuauuuaacaaugaacaauaaacauuggcucguacauaaagaaugguuucaugacauaccucuaccuuggcacgcaggagcagauacaggaacuccacauuggaauaauaaagaagccuuaguagaauuuaaagaugcacaugcaaaaagacaaacaguagucguacuaggaagccaagaaggagcaguacauacugcauuggcaggagcauuagaagcagaaauggacggugcaaaaggaagguuaucaaguggacaucuaaaaugcagacuuaaaauggauaaauuaagauuaaaaggaguaaguuauucauuaugcacagcagcauuuacauuuacaaaaaucccagcagaaacacuacauggaacaguaacaguagaaguacaauacgcaggaacugauggaccauguaaaguaccagcacaaauggccguugauaugcaaacauuaacaccaguaggaagauuaauaacagcaaauccaguaauaacagaaaguaccgaaaacaguaaaaugauguuagaacuagauccuccauuuggagacaguuacauaguuauaggaguaggagaaaaaaaaauaacacaccauuggcacagaaguggaagcacaauagguaaagcauuugaagcaacaguaaggggagcaaaaagaauggcaguacuaggagauacagcaugggauuucggauca

SEQ ID NO: 2477 - RNA, 2061 nt, Artificial Sequence
  ZIKV (strain ZikaSPH2015) Polyprotein(108-794)(F398S) CDS opt
acaucaguaggaauuguuggauuauuacuaacaacagcaauggcagcagaaguaacaagacgaggaagcgcauauuauauguaucuggauagaaaugaugcuggugaagcaauaaguuuuccaacaaccuuagguaugaauaaauguuacauucaaaucauggauuuaggacacaugugugaugcaacaaugucauaugaauguccuaugcuagaugaaggcguugaaccagacgauguggauuguuggugcaacacaacaaguacaugggugguauaugguacgugucaucacaagaaaggagaagcaagaagaucaaggagagcaguuacacuuccaagccauaguacaagaaaauuacaaacaagaagucaaacaugguuagaaucaagagaguacacaaaacaccuaauuagaguagaaaauuggauauucagaaauccaggguucgcacucgcagcagcagcuauagcaugguuacuaggaaguaguacaagucaaaaaguaauauaucuaguaaugauacuauugaucgcgccagcauauucuauaagauguauaggaguaagcaauagagauuuuguagaagguaugucuggagguacauggguagauauaguauuagaacacggcggaugcgucacaguaauggcccaagauaaaccaacaguagauauagaacucguaacaacaacaguuaguaauauggcagaaguaagaagcuacuguuacgaagccaguauaucagacauggcaagugauucaagauguccaacacagggagaagcauauuuagauaaacaaucugacacacaauauguuugcaaaagaaccuuaguagacagaggauggggaaacggaugcggacuaagcggaaaagguagcuuaguaacaugugcaaaauucgcaugcucaaagaaaaugacuggaaaaagcauacaaccagaaaacuuagaauauagaauuauguuaaguguacauggaucacaacacaguggaaugauaguaaacgacacuggacaugaaaccgaugaaaaucgagcaaaaguagaaauaacaccuaauagcccgagagcggaagccacacuaggaggauucggaaguuuaggacuagacugugaaccaagaacaggauuagacuuuagugaucuauauuauuuaaccaugaacaauaaacauugguuaguucauaaagaaugguuccaugacauaccauuaccauggcacgcaggagcagauaccgguacgccgcauuggaauaacaaagaagcucuaguagaauuuaaagaugcacaugcaaaacgacaaacuguagugguacuaggaucacaagaaggagcaguucauacagcuuuagcgggggcgcucgaagcagagauggacggugcaaaagguagauuaaguucaggacaccuaaaauguagacuaaaaauggauaaacuaagauuaaaaggaguaucguauucuuuauguacagcugcguuuaccuuuacaaaaauuccagcagaaacauuacauggaaccgucacaguugaagugcaauacgcaggaacugaugguccaugcaaagucccugcacagauggcaguagauaugcaaacgcuaacaccgguaggacgauugaucacugcgaauccugugauaacugaaagcaccgaaaauucaaaaaugaugcuggaauuagauccuccauuuggagacaguuacauaguaauaggaguaggagaaaagaaaauaacacaucauuggcacagaucaggaaguacaauaggcaaagcauuugaagcuacagugaggggagcaaaacgaauggcaguauuaggugauacagcaugggacuuuggcaguguaggaggggcacuaaauucuuugggaaaagguauacaucaaaucuuuggagcagcauuuaaaaguuuauuuggaggaaugagcugguuuucacaaauuuugauaggcacuuuauuaaugugguuaggacuaaauacuaaaaauggaucaauaucauuaauguguuuagcuuuaggaggcguauuaauauuuuuauccacagcagugagcgcu

SEQ ID NO: 2478 - RNA, 2061 nt, Artificial Sequence
  ZIKV (isolate Z1106033) Polyprotein(108-794)(F398S) CDS opt
acauccguaggaauuguaggauuauuacuaacaaccgcaauggcagcagaaguaacgcgacgaggaagugcauauuacauguacuuagauagaaaugacgcuggugaagcaauaaguuuuccuacaacucuugggaugaacaaauguuacauccaaauaauggaucuuggccauacaugugaugcaacaaugucauaugaauguccaauguuagaugaaggagucgaacccgacgaugucgauuguuggugcaauaccacaucaacauggguuguauauggaacaugccaucauaagaaaggagaagcgcggagaaguagacgagcaguaacauuaccaucacauucgacacgaaaauuacaaacaagaagucaaacaugguuagaaagcagagaauacacaaaacauuuaauaagaguagaaaacuggauauuuagaaauccaggguuugcauuagcagcagcagcaauagcauggcuucuaggauccaguaccucacaaaaaguaauauacuuaguaaugauauuauugauugcaccagcuuauucuauaagauguauuggaguuagcaauagagauuuuguagaagggaugaguggaggaacauggguagauguaguuuuagaacacggagguuguguaacaguaauggcacaagauaaaccaacaguagauauagagcuaguaacaacuacugugagcaauauggcagaaguucgaucauacuguuacgaagcaucaauaagugacauggcaucggauagcagauguccaacacaaggugaagcauaucuagauaaacaaucagauacucaauauguauguaaacgaacuuuaguagauagaggauggggaaauggaugcgguuuaagcggaaaaggcucauuaguuacaugugcuaaauucgcuuguaguaagaaaaugacaggaaaaucaauacaacccgaaaaucuagaauaucgaauaauguuauccguacauggaagccaacauucagguaugauaguaaaugacacaggacaugaaacagacgaaaauagagcuaaaguagaaauaacuccuaauucaccaagagcagaagcuacacuaggagguuucgguagccuaggguuagauugugaaccaagaacaggauuagacuuuucagacuuauauuaccuaacaaugaauaauaaacauugguuaguucacaaagaaugguuucacgauauaccauugccuuggcaugcaggagcagauacuggaacaccacacuggaauaauaaagaagcauuaguagaauuuaaagaugcacacgcaaaaagacagacaguugucguauuagggucacaagaaggagcuguacauacagcauuagccggagccuuagaagcagaaauggacggagcaaaaggaagacuaaguagcggacaucuuaaauguagacuaaaaauggacaaacuacgacugaaaggaguaucauauucauuauguacagcagcuuuuacauucacaaaaauaccagcugaaacccuacauggaacaguaacagucgaaguucaauacgcaggaacggacggaccauguaaaguaccagcucaaauggcaguagacaugcagacuuuaacaccaguagggaggcuaauuacagcaaacccuguuauaacagaaucaacggaaaacucaaaaaugauguuggaauuagauccaccuuuuggagacucauacauaguaauaggaguaggagaaaagaaaauaacacaucacuggcaucgaaguggaucaacuauugguaaagcauuugaagcaaccguaagaggagcuaaaagaauggcuguuuuaggugauacagcgugggauuuuggcucagugggaggugcauuaaacucuuuaggcaaagggauacaccaaauauuuggugccgcauuuaaaucauuauucggaggcaugucaugguucagccaaauauuaauaggaacauuauuaaugugguuaggucuaaacgcaaagaacggaaguauuucucuaauguguuuagcauuaggaggaguucuaauauuucuaucaaccgcaguuucagca

SEQ ID NO: 2479 - RNA, 2049 nt, Artificial Sequence
  ZIKV (strain MR 766) Polyprotein(108-790)(F398S) CDS opt
acaucaauuggaauaaucggcuuauugcuaacuacagcaauggcagcugaaauuacaagaagaggaucagcuuauuauauguaucuagacagaucagaugcugguaaagcaauuucauucgcaacaacacuaggcguaaauaaaugucacguacaaauaauggauuuaggccauaugugcgaugcaacaaugucguaugaauguccaauguuagacgaaggaguggaacccgaugauguagacuguuggugcaacacaacuucaacauggguaguauacggaacaugccaucacaaaaaaggagaagcaagaagaucaagacgagcaguuacucuaccaagccauaguacaaggaaacuacaaaccagaucacaaacauggcuagaaucacgugaauacacaaagcauuuaauaaaaguagaaaacuggauauuuagaaauccaggguucgcauuaguggcaguagcaauagcauggcuauuaggaucaucaacaucacaaaaaguaauauauuuaguaaugauauuauuaauagcgccagcauauaguauacgauguauaggaguaucaaacagagauuuuguggaaggaaugucaggagguacauggguggacguaguucuagaacacggaggcuguguaacaguaauggcacaagacaaaccuaccguagauauagaacuagugaccacaacaguaucaaacauggcggaaguaaggucuuauugcuaugaagccaguauaucagauauggcaucugauagcagaugcccaacacaaggagaagcauaucuugauaaacaaucugauacacaauauguauguaaaagaaccuuaguagaucgaggauggggaaaugguuguggacuaucagguaaagguucauuagucacaugugcuaaauucacuuguaguaaaaaaaugacaggaaaaucuauacaaccagaaaaucuugaauauaggauaauguuaaguguccacggaagucaacauucagggaugauagguuaugaaacagaugaagacagggcaaaaguagaaguaacaccaaacagcccaagagcggaagcaacauuaggaggauucggaagccucggacuagacugugaaccacggacgggauuagacuucagcgaucuuuauuauuuaacaaugaauaauaaacacuggcuaguucauaaagaaugguuccaugauaucccucuaccauggcaugcaggagcagauacaggaacaccccacuggaauaauaaagaagccuuaguagaauuuaaagaugcccacgccaaaagacaaacgguaguuguauuaggaucacaagaaggagcaguacauacggcguuagcuggcgcccuagaagcagaaauggauggugcgaaaggaagacuauuuucaggccaucucaaaugcagauugaaaauggauaaacuuagacuaaaaggaguaucauauucauuauguacagcagcauuuacauuuaccaaaguaccagcagaaacauuacauggaacaguuacaguagaaguucaauaugcagguacagauggaccuuguaagauaccaguacaaauggcgguagauaugcaaacacucacuccaguugguagauuaauuacugcaaacccaguaauaacagaaucgacggaaaauucuaaaaugauguuagaauuagacccaccauuuggagauaguuauauagugauaggugugggagauaaaaaaauaacacaucauuggcaucgaucagggucaacuauagguaaagcauucgaagcaacagugagaggggcaaaaaggauggcaguacuaggagauacugcaugggauuuuggcagugucggugggguuuuuaauagccuagguaaaggaauacaccaaauauuuggcgcagcguucaaaucauuauuuggcggaaugucaugguuuucucaaauacuuauaggaaccuuacuaguaugguuggguuuaaacaccaaaaauggaaguauuucacuaacauguuuagcccugggaggaguaaugauauuucuaagcacagcaguaagugca

SEQ ID NO: 2480 - RNA, 2061 nt, Artificial Sequence
  ZIKV (strain NatalRGN) Polyprotein(108-794)(F398S) CDS opt
acaucaguaggaauaguaggacuacuauuaacaacagcaauggcagcugagguaacaagaagaggaagcgcuuauuauauguauuuagauagaaaugaugcaggagaagcuaucagcuucccaacaacacuaggaaugaacaaauguuauauacaaauaauggauuuaggccacaugugcgaugcaacaaugagcuaugaauguccaauguuagaugaaggaguagaaccugaugauguugauuguuggugcaacaccacaaguacauggguaguuuauggaacaugccaucacaagaaaggugaagcacgaagaucaagacgagcaguaacacugccaucucauucaacacgaaaauuacagacaagaagucagacauggcuugaaaguagagaauauacgaaacaccuaauacgcguagaaaauuggauauuuagaaacccuggauuugccuuggcggcagcagcaauagcuugguuauuagguucuaguacaucacaaaaaguaauauaucuaguaaugauacuacuaauagcaccagcauacucaauaagaugcauaggaguaagcaacagagauuucguagaaggaaugaguggaggaaccuggguagauguaguccuagagcacggaggauguguaacaguaauggcacaagacaaaccaacuguagauauagaacuuguaacaacaacgguaucaaacauggcagaaguacgaaguuacugcuacgaagcaucaauaucugacauggcuucagauucaagaugcccaacacaaggagaagccuaucuagauaaacaaucagacacacaauacguuugcaaacgaacauuaguagaccgagguuggggaaacggaugugggcuaucagggaaagguucacuuguaacaugugcaaaauuugcaugcucaaagaaaaugaccgguaaaaguauucaaccagaaaaucuagaauacagaauuaugcuaucaguacacggaucacaacauagugguaugauaguaaaugacacuggacaugagacugaugaaaauagagcaaaaguagaaauaacaccaaauaguccaagagcagaagcaacauuaggaggauuugguaguuuaggacucgacugugaaccacggacugggcuggauuuuagugacuuauauuacuuaaccaugaauaauaaacacugguuaguacacaaagaaugguuccaugauauaccuuugccauggcaugcuggugcagauacaggaacuccccauuggaauaauaaagaagcacuuguagaauuuaaagaugcacacgcaaaacgacaaacaguaguuguacuagguucccaagaaggagcaguacauacagcacuugcaggagcucuagaagcugaaauggauggagcuaaaggacgauuaaguaguggacaccuaaaauguagacuuaaaauggacaaauuaagguuaaaaggaguaaguuauucauuauguacagcagcauucaccuucacuaaaauaccugcggaaacacuccacgguacaguaacuguagaaguacaauaugcaggaacagauggaccauguaaaguaccagcacaaauggcuguggauaugcaaacacuaacucccguaggaagacuaauaacugcaaacccaguaaucaccgagaguacagaaaacucuaaaaugauguuagaauuagauccaccauuuggagauucauacauuguaauuggaguaggugaaaagaaaauaacucaccauuggcauagaucuggaaguacaauaggaaaagccuucgaagcaacaguaagaggugcuaaacggauggcaguauuaggagauacggcaugggauuuugguucuguagguggagcacuaaacucccuagggaaagggauucaccaaauuuuuggagcagcauuuaaaucauuauuuggaggcaugagcugguuuucacagauacuaauagguacauuacuuaugugguuggguuuaaacacuaaaaacgguucaauuucauuaaugugcuuagcacuaggugguguguuaauauuucuaaguacagcgguuagugcu

SEQ ID NO: 2481 - RNA, 2061 nt, Artificial Sequence
  ZIKV (strain ZikaSPH2015) Polyprotein(108-794)(N444Q) CDS opt
accagcguaggaauuguagggcucuuauuaacaacagcuauggcagcagaagugacaagaagggguagugccuauuacauguacuuagauagaaaugacgcaggugaagcaauuucauuuccaacaacauuaggaaugaauaaauguuacauacaaauaauggaccuaggacauaugugugacgcaacaaugaguuaugaaugucccauguuagacgaggggguugaaccagaugauguagauugcugguguaauacaacgaguacguggguaguauauggaacgugucaucauaaaaaaggagaagcucguagaaguaggagagcaguaacuuuaccaagucacucaacaagaaaauuacaaacaagaagccaaacaugguuagaaucaagagaauauacaaaacaucucauaagaguagaaaauuggauauuuagaaauccaggauuugcauuagcagcugcugcaauugccugguuacucggaaguuccaccucacaaaaaguaauauaccucguaaugaucuuguuaauagcaccagcuuauucgauaagauguaucggaguuaguaauagagauuuuguugaaggcaugagcggagggacauggguagauauaguacuugaacauggcggauguguuacaguaauggcacaagauaaaccaacgguagauauugaauuaguaacaacaacagucaguaacauggcugaaguaagaucauauugcuaugaagcuaguauaucugauauggcuagugauaguagauguccaacucaaggagaagccuauuuagauaaacaaagugacacucaauauguuuguaaaagaacauuaguagacagaggauggggaaaugguuguggauuauucggaaaaggaagcuugguaacaugugcaaaauucgcauguaguaaaaaaaugacaggaaaaucuauucaaccagaaaacuuagaauauaggauaauguuaucagugcacggcucacaacauaguggaaugauaguacaagacacagggcaugaaacagaugaaaauagagcaaaaguagaaauaacuccaaacaguccuagagcugaagcaacucuagguggauuuggaaguuuaggcuuagauugugaaccaaggacaggauuagauuuuagugauuuauauuaccuaacaaugaauaauaaacauuggcuuguacauaaagaaugguuccaugauauuccacuaccauggcaugcaggagcagacacugguacuccacauuggaauaacaaagaagcauuaguugaauuuaaagaugcccaugcuaaaagacaaacaguaguaguauuaggaagucaagaaggagcuguucacacugcacuugcaggagcacuagaagcagaaauggauggagcaaaaggacgguuaagcaguggacauuuaaaaugcagacuaaaaauggauaaacuucgauuaaaagggguaucauauaguuuauguacugcagcuuuuacguuuacaaaaauaccagcggaaacacuacauggaacaguuacaguugaaguacaguaugcaggcacugauggaccuuguaagguaccagcgcaaauggcaguagacaugcaaacacuaacuccagugggacgacuaauaacagcaaauccaguaauaacagaaagcacagaaaauaguaaaaugaugcuagaacuagacccaccauuuggagacucauacauagucauaggcguaggagaaaaaaaaauaacccaucauuggcacagaaguggaucaacuauaggaaaagcauuugaagcaacaguucguggagcaaagagaauggcaguauugggagacaccgcaugggauuucgguaguguuggaggugcacuuaauucauugggaaaaggaauacaucaaauuuuuggagcagcuuucaaaaguuuauucggcgggaugucaugguucagucaaauauuaauagguacuuuacuaaugugguuaggauuaaauacaaaaaaugguagcauuucacuuaugugucuagcauuaggagguguuuugauauuucuaucaacagcugugucagcu

SEQ ID NO: 2482 - RNA, 2061 nt, Artificial Sequence
  ZIKV (isolate Z1106033) Polyprotein(108-794)(N444Q) CDS opt
acaucagucggaauagucggacuucuauuaacuacugcaauggcagcagaagucacaagaagaggaucagcuuauuacauguacuuagauaggaaugaugcuggagaagccauuagcuuucccaccacuuuaggcaugaauaaauguuacauacaaauaauggauuuaggacauacaugugaugcaacaaugucauacgaaugucccauguuagaugaagguguagaaccagaugauguugauuguuggugcaauacaacaucaacauggguaguauacggaacaugccaucauaagaaaggagaagcaaggcgaucaagacgagcaguuacauugccuagucauaguaccagaaaauuacaaacaagaucucaaacaugguuagaaaguagagaauacacaaaacaucuaauaagaguugaaaacuggauauucagaaauccaggauuugcacuagcagcagcagccauagcauggcuauuaggaucaagcacaagucaaaaaguuauauacuuagugaugauauuauuaauagcaccagcuuacucuauaagauguaucggagucuccaacagagauuuuguagaaggaaugucaggaggaacauggguugauguaguauuagaacaugguggauguguaacaguaauggcacaagauaaaccaaccguagauauagaauuagucacaacaacuguaucaaauauggccgaaguaagaaguuacuguuaugaagcaucaauuucugacauggcuucagauagccgcugccccacacaaggcgaggcauauuuagacaaacaaagcgauacacaauauguauguaaaagaacucuaguugauagaggaugggguaauggauguggacuauucgguaaagguucauuaguaacaugugcaaaauuugcuuguagcaagaaaaugacagggaaaucaauccaaccagaaaaucuagaauauagaauaauguuaucagugcacggaagucagcacucagguaugauaguucaagauacaggacaugaaacagacgaaaauagagcaaaaguggaaaucacgccaaauucaccaagagcugaagcuacccuagguggcuuuggaucauuaggcuuagauugcgaaccaaggacaggauuagauuuuucagaucucuacuauuuaacaaugaauaauaaacacuggcuaguccacaaagaaugguuccaugauaucccauugccuuggcaugcuggagcagauacagguacaccacauuggaauaacaaagaagcacucguagaguucaaagaugcacaugcaaaaagacaaacaguaguaguacuaggaucccaagaaggugcaguucacacugcacuggcaggagccuuagaagcagaaauggauggagcaaaaggaagauuaucaaguggacaccuaaaauguagauuaaaaauggauaaacuaagauuaaaaggaguauccuauucccucugcaccgcagccuucacuuuuacuaaaauaccagcagaaacauugcauggaacaguuaccguagaaguacaauacgcaggaacugauggacccuguaaaguacccgcacaaauggcaguagauaugcaaacacucacaccaguaggaagauuaauaacagcaaauccaguaauaaccgaaucaacagaaaacagcaaaaugaugcuugaauuagauccaccuuuuggagauucauauauaguaauugguguaggcgaaaagaaaaucacacaucauuggcauagaaguggaucaaccauaggaaaagcauuugaagcaacaguaagaggggcaaaacgaauggcgguccuaggagacacggcaugggauuuuggaucaguaggaggagcauuaaauucacuaggaaaaggcauucaucaaauauucggagcugcauucaaaaguuuauucggaggaaugucaugguuuagucaaauacuuauaggcacauuauuaauguggcuaggauuaaacgccaaaaaugggucaauaucacucauguguuuagcuuuagguggaguauuaauauuuuuauccacagcaguaucugca

SEQ ID NO: 2483 - RNA, 2061 nt, Artificial Sequence
  ZIKV (strain NatalRGN) Polyprotein(108-794)(N444Q) CDS opt
acaagcgugggaauaguuggacuacuauuaacaacagcaauggcagcagaagugacucgucggggaagugcauauuauauguauuuagauagaaaugacgcaggagaagcaauuaguuuuccaacaacauuaggaaugaauaaauguuacauacaaauuauggaucuaggacacaugugugaugcaacaaugucauaugaauguccgaugcuagacgaaggaguagagccagaugauguugacugcuggugcaauacaacaagcacauggguagucuacggaacuugccaucauaagaaaggagaggcacgaagaagccggagagcuguaacuuuaccuagccauucuacucgaaaauuacaaacaagaucacaaacuuggcuagaaagucgagaauauacaaaacauuuaauaagaguagaaaacuggauauuccguaauccuggguuugcucuugcagcagcagcaauagcguggcuacuaggaaguagcacaagucaaaaaguaauauacuuagugaugauauuauuaauagcuccagcauauucaauuagauguaucggugugaguaauagagauuucguagaaggaaugaguggagggacuuggguagauguaguuuuagaacacggaggaugugucacagugauggcucaagacaaaccaacuguagacauagaacuuguaacuaccacaguaucaaacauggcagaaguuagaaguuauuguuaugaagcaucuauaucagauauggcaucagauucacgauguccaacacaaggcgaagcguaucuagauaaacaaucggauacucaauauguauguaaaagaacuuuaguagauagaggauggggaaauggauguggccuauucggaaaaggaucauuagugacaugcgcuaaauuugccuguagcaagaaaaugaccgguaaaaguauucaaccagaaaauuuagaauauagaauaauguuaucaguucacggaucacaacauaguggaaugauaguucaagauacaggccacgaaacugacgaaaauagagcaaaaguagaaauaacaccaaauucuccaagagcagaagcaacacuaggcggauuuggaucauuaggauuggauugugaaccucgaacaggauuagacuuuagugauuuguauuauuuaacaaugaacaacaaacauugguuaguacacaaagaaugguuucacgauauaccacuaccauggcaugcaggagcagauacgggaacaccccauuggaauaauaaagaagcgcuuguagaauuuaaagaugcucaugcaaaaaggcaaacaguaguaguauuaggaagucaagaaggagcaguacauacagcucuagcuggagcccuggaagcugaaauggauggggcuaaaggaagacuuagcucaggacaucuaaagugccgauuaaagauggacaaauuaagauuaaaaggcguaaguuauucuuuauguacagcagcauuuacauuuacaaaaauaccagcagaaacgcugcaugguacuguaacaguagaaguacaauaugcaggaacugacggaccauguaaaguaccagcacaaauggcgguugauaugcaaacauuaacaccuguaggaagacucauuacagcaaacccaguuauaacagaaucuacagaaaauuccaagaugaugcuggaguuagaucccccauuuggugauaguuauauaguuaucgguguaggugagaagaaaauaacacaucacuggcaccgaaguggaucaacaauagguaaagcauucgaagcaacaguaagaggagcaaaaaggauggcaguauuaggugacacagccugggauuuuggaucuguaggaggagcacuuaauucauuaggaaaaggcauucaccaaauauuuggagcagcauuuaaaucauuauucgguggaaugucaugguuuucacaaauuuugauagguacacuacuaauguggcuaggacuaaacaccaaaaaugggucaauaagucuaaugugcuuagcguuaggaggaguacuaauauuccuaaguacagcaguaucagca

SEQ ID NO: 2484 - RNA, 2061 nt, Artificial Sequence
  ZIKV (strain ZikaSPH2015) Polyprotein(108-694)-Cterm-JAEV1-E(400-500) CDS opt
acauccguagguauaguagguuuacuauuaacuacugcgauggccgcagaagucacaagaagagguucagcuuacuauauguaucuagaucguaaugacgcaggagaagcaauaucauucccuacaacauuagguaugaauaaauguuauauccaaauaauggauuuagggcauaugugugaugcaacaaugaguuaugaaugcccaaugcuagaugaaggaguagaaccagacgacguugacugcugguguaauacaacaagcacauggguaguauacggaacaugucaccauaaaaaaggagaagcucgaaggucacgacgagcgguuacauugccaucucauaguacaagaaaacuacagacaagaucacagacauggcuagaaaguagagaauacacaaaacaucuaauucgaguagaaaacuggauauuuagaaauccaggcuuugcacucgcagcagcugcaauagcauggcucuugggaaguucaacaucacagaaaguaauauaccuaguaaugauauuacuuauagcaccagccuauaguauuagguguauaggaguaucuaauagagauuuuguagaaggaaugagcggagggacauggguagauauaguacuagaacauggaggauguguaacuguaauggcacaagauaaaccaacaguugacauagaacuaguaacaacaacaguaucaaauauggcagaaguaagaaguuauuguuaugaagcgaguauaagugauauggcaucagauucaagaugcccuacacaaggagaagcauaccuagacaaacaaucggauacacaauauguauguaaaaggacauuaguugauagagguugggggaacggauguggguuauucggaaaaggaaguuuaguaaccugcgccaaauuugcauguaguaagaaaaugacagggaaaaguauccaaccugaaaaucuggaauacagaauuauguuaagugugcauggaagucaacacaguggaaugauaguaaaugauacgggacacgaaacagaugaaaauagggcaaaagucgaaauuacaccaaacagccccagagcagaagcaaccuuaggaggauuuggaucauuaggauuagauugcgaaccaagaaccggauuagacuuuagcgaucuguacuauuugacaaugaauaauaaacauuggcuaguacauaaagaaugguuccaugauauaccauuaccauggcacgcaggugcugauacuggcacaccacauuggaacaacaaagaagcacucguugaauucaaagacgcccaugcaaaacgacaaacaguagucguuuuaggaucacaagaaggagccguacacacugcauuagcaggagcauuagaagcagaaauggauggcgccaaagggagacuaucgaguggucaucuuaagugcagacuaaaaauggauaaauuaagguuaaaaggaguaaguuacucucuaugcacagcagcauuuacauuuacuaaaauaccugcugagacauuacauggaacuguaacuguagaaguacaauacgcagggacugauggaccauguaaagugccagcacaaauggcaguagauaugcaaacauuaacaccaguaggacgauuaauaacggcaaauccaguaaucacugaaucaacugaaaauaguaaaaugauguuagaguuagauccaccauucggcgauaguuauauaguaauaggagugggcgaaaaaaaaaucacucaucauuggcacagaagcggcaguacauuaggaaaagcauucagcacaacauuaaaaggagcucaaagauuagcagcacuaggugauacagcaugggauuucggaucaauuggaggaguauucaauucaauagggagagcagugcaucaaguauucgguggcgcauuuagaacucuguucggaggaaugaguuggauaacacaaggacuaaugggugccuuauuauuauggaugggaguaaaugcacgagaccgaucaauagcacuagcauuucuagcaacuggagguguauuaguauuucuggcaacuaacguccacgca

SEQ ID NO: 2485 - RNA, 2061 nt, Artificial Sequence
  ZIKV (isolate Z1106033) Polyprotein(108-694)-Cterm-JAEV1-E(400-500) CDS opt
accaguguaggaauaguagguuuacuccuuaccacagcaauggcggcagaaguaacacggagaggaucugcauauuacauguaccuugacagaaaugacgcgggagaagcaauaaguuucccaacaacacuagggaugaauaaaugcuacauucaaauuauggaucuaggacauacaugugaugcgacgaugagcuaugaaugcccaauguuagaugaagguguagaaccagaugauguagacugcugguguaauacuacaucgaccuggguuguauauggaacaugucaucauaagaaaggagaagcacgaagaagcaggagagcaguaacauuacccagucauucaacaagaaaauuacaaaccagaucacaaacauggcuagaaucaagagaauauacaaaacauuuaauaagaguagaaaacuggauuuuuagaaauccaggauuugcauuagcugcugcagcuauagcauggcuucuuggcaguucaaccagccaaaaaguuauauauuuggucaugauuuugcuaauagcaccagcauauaguauacgauguauaggaguaucaaauagagacuuuguugaaggaaugucuggaggaacaugggucgauguaguacuagaacauggaggauguguaacaguaauggcacaagauaaaccaacaguugauauagaauuaguaacaacaacaguaucgaauauggccgaaguaagaaguuauuguuaugaagcaucaauauccgauauggcaucagauagcagauguccaacucaaggagaagcauaccuagauaaacaaucagauacucaauauguuuguaaaagaacauuaguugacagaggcugggguaauggaugcgguuuauucggcaaaggcucauuaguaacaugugcaaaguuugcauguucaaagaaaaugacaggaaaaucaauacaaccagaaaauuuagaauaucgaauaauguuaaguguacauggaucccagcacucaggaaugauaguuaaugauacaggucacgaaaccgaugagaauagagcaaaaguagagauaacuccaaauaguccaagagcagaagcuacauuaggaggauuugguagcuuagguuuagauugugaaccacgaacaggauuagauuucagugaucuauauuaucuaacuaugaauaauaaacacugguuaguacauaaagaaugguuucaugauaucccacuuccauggcaugcaggagcagauacaggaacaccccauuggaauaauaaagaagcauuggucgaauuuaaagaugcacaugcaaaaaggcaaacaguuguaguguuaggaucacaagaaggagcuguacacacagcacuugcuggugcacuugaggcagaaauggauggagcaaaaggaagacugagcagcgggcauuuaaaauguagauugaaaauggauaaauuacgccugaaaggaguaaguuauagucuauguaccgcagcauuuacauuuacaaaaauaccagcugaaacgcuacauggaacggucacaguagaaguacaauaugcagguacagauggaccauguaaaguaccagcacaaauggcaguagacaugcaaacacuaacaccaguuggaagauugaucacugcaaauccaguuauaacagaaucaacugaaaauucgaaaaugauguuagaguuagacccuccguuuggugacucauauauaguaaucggaguaggagaaaagaaaauaacacaucacuggcauagaucaggaaguacacuaggaaaggcuuuuagcacaacauuaaaaggugcucaaagauuagcagcauuaggcgauacagcuugggacuuuggaucaauaggcggaguauuuaacaguauaggaagggccguacaucaaguauuuggaggagcauuuagaacacucuuuggaggaaugagcuggauaacacaagguuuaaugggagcauuauuacuuuggaugggaguaaaugcacgagaucgaaguauagcauuagcauuucuagcaacugguggaguccuaguauuucuagcaacaaacguacaugcu

SEQ ID NO: 2486 - RNA, 2049 nt, Artificial Sequence
  ZIKV (strain MR 766) Polyprotein(108-690)-Cterm-JAEV1-E(400-500) CDS opt
acaucaauagguaucauaggccuauuacuaacuacagcaauggcagcagaaauaacuagaagagguucagcauauuacauguaucuagauagaagugaugcagguaaagcaauaaguuuugcaacaacauuaggaguaaauaaaugccauguacaaauaauggaucuaggucauaugugugacgcaacaaugaguuaugaaugcccuaugcuagacgaaggaguugaaccugaugacguagauuguuggugcaacacaacaaguacuugggugguauauggaacuugucaucacaagaaaggagaagcaagacgaucaagacgagccguaacucuaccaucucacucaacaagaaaacuacaaacacgcucacagacaugguuagaaucaagagaauacacuaaacauuuaauuaaaguugaaaacuggauuuuucgaaauccagguuuugcauuaguagcuguagccauagcauggcuacuaggaaguucuacaucucaaaaaguaauauaucuuguaaugauacuacuaauagcuccagcauauucaauuagauguauaggaguaagcaauagagauuucguagaaggaaugaguggaggaacauggguagauguaguauuagaacauggugguuguguaacaguaauggcacaagacaaaccaacagucgacauagaauuaguuacaacuacgguaaguaacauggcagaaguuaggaguuauuguuaugaggcaucaauaagcgauauggcgucagauucaagaugcccaacacaaggagaagcauauuuagacaaacaaagugauacgcaauacguauguaaaagaacucuaguagacagggguuggggaaauggaugcgguuuauuuggaaaaggcagucuaguaacaugcgcaaaauuuacauguucaaagaaaaugacaggaaaaucuauucaaccugagaauuuagaauaucgaauaauguuaucuguacauggaucucaacauucaggaaugauaggguaugaaacugacgaagauagagcaaaaguagaaguaacgcccaauucuccaagagcagaagcaaccuuaggcggauuuggaaguuuaggacuagauugugaaccaagaacaggucuagacuuuucagaucucuacuaucuaacaaugaauaauaaacacuggcuugugcauaaggaaugguuucaugauaucccauuaccauggcaugcaggagcagacacaggaacaccucauuggaauaauaaagaggccuuaguagaauuuaaagaugcacaugcgaaaagacaaacaguaguaguuuuaggaagucaagagggagcaguucauacagcauuagccggagcacuugaagcggaaauggauggagccaaaggacgucuauuuaguggacacuuaaaaugcagauuaaaaauggauaaacuuagacuaaaaggugucucauacucucuaugcacagccgcguuuacauuuaccaagguaccagccgaaacacuucacggaaccguaacuguagaaguacaauaugcaggaacagauggaccauguaaaauuccuguacaaauggcaguagauaugcaaacauuaacacccguagguagauuaauaacagcaaaucccguaauuacagaaucaacagaaaauaguaaaaugauguuagaacuagauccuccauuuggagauucauauauaguaauaggaguaggugacaagaaaauaacacaucauuggcacagaagugguagcacauuaggaaaagcauuuaguacaacacucaaaggagcacaaagauuagcagcacuaggagauacagcaugggacuuuggaagcauuggagguguauuuaauaguaucgguagagcaguucaucaaguguuuggaggagcauucagaacacuauuuggagguaugucuuggauuacacaagguuuaaugggugcauuauuauuguggaugggaguaaaugcacgagaucguucaauagcauuggccuuuuuagcaaccgguggaguccugguguuuuuagcaacuaauguccaugca

SEQ ID NO: 2487 - RNA, 2061 nt, Artificial Sequence
  ZIKV (strain NatalRGN) Polyprotein(108-694)-Cterm-JAEV1-E(400-500) CDS opt
acaucuguagguauaguaggacuccuuuuaacaacagcaauggcagcagaaguaacgagaagagguagcgcauauuauauguauuuagauagaaacgacgccggagaagcaauuagcuuuccuacaacauuaggcaugaauaaauguuauauacaaauaauggaccuuggacauaugugugaugcaacuaugagcuaugaaugcccuaugcuagaugagggaguagaaccagaugacguagauuguugguguaacacaacaagcacaugggucguuuauggcacaugccaucauaaaaaaggagaggcaagacguagucgaagagcaguaacacuaccaucgcauucaacacgaaaauuacaaacuagaagccaaacauggcuagaaucacgagaguacacaaaacauuuaauaagaguagaaaacuggaucuuuaggaauccugguuuugcacuagcagcagcagcaaucgcauggcuacucggaaguaguacgagucaaaaaguaaucuaucuaguaaugauuuuacuaauagcacccgcuuacucaauaagguguauagguguaucaaauagagauuuuguggaagguaugagugguggaacauggguugauguaguacuagaacauggaggaugugucacaguuauggcucaagauaaaccaaccguugauauagaguuaguuacuacuaccguuuccaauauggcagaaguaagaagcuacugcuaugaagcaagcaucucagauauggcaucagauucaagaugcccaacccagggagaagcauauuuagacaaacaaucagauacacaauauguaugcaaaaggacauugguugauagaggaugggguaauggaugcggauuauuuggcaaaggaucucuaguaaccugugcuaaauucgcaugcucuaaaaaaaugacaggaaaaucgauucaaccggaaaaucuugaauaccgaauaaugcuuucaguacauggaagccaacauucaggaaugaucguaaacgauacaggucacgaaacagaugagaauagagcuaaaguagaaauaacuccaaauagcccacgugcugaagcuaccuuaggaggauuugggucuuuaggauuagauugcgaaccacgaacaggauuagauuucucagaccucuauuaucucacaaugaacaauaaacauugguuaguccauaaagaaugguuccaugacaucccacuaccauggcacgcaggugcggacacuggaacaccgcacuggaacaacaaagaagcacuagucgaauucaaggaugcucacgcaaaaagacaaacaguaguaguacugggaucacaagaaggagcaguacacacagcuuuagcaggagcauuagaagcagaaauggacggagcaaaaggaagauuaagcagcggacaucuuaaauguagauuaaaaauggauaaauugagauuaaaaggagucucguauucauuaugcacagccgcauuuacauuuacaaaaauacccgccgaaacacuacauggaacaguuacugucgaaguacaauaugcagggacagacgguccauguaaaguaccugcacaaauggcaguugacaugcaaacacuaacaccaguaggaagauuaaucacagcaaacccaguaauaacagaaucuacagaaaacaguaaaaugauguuagaauuagauccaccuuuuggcgauuccuauauaguaauuggaguaggagaaaaaaaaauuacacaucauuggcauagaagugguucaacacuaggcaaagcuuuuucaaccacacuaaaaggugcucagcgacuagcagcacuuggagauacagcaugggauuucggaaguaucggaggagucuuuaacucaauaggucgagcaguucaucaaguauucggcggagcauuuagaacacuauuugguggaaugucauggauaacacaaggacuaaugggagccuuauuauuauggaugggaguaaaugcgagagauagaaguauugcauuagcauuuuuagcaacugguggaguacuaguauuuuuagcaacuaacguacaugcg

SEQ ID NO: 2488 - RNA, 2136 nt, Artificial Sequence
  ZIKV (strain ZikaSPH2015) Polyprotein(93-804) CDS opt
agaauuauaaacgcucgaaaagaaaaaaaaagacgaggagcagauacaaguguugguauaguagguuuauuguuaacuacugcaauggcagcagaaguaacaagacgaggaagcgcuuauuauauguaucuagacagaaaugaugcaggagaagcgauaaguuucccaacuacauuagguaugaauaaauguuacauacaaauaauggauuuagggcauaugugugaugcaacaaugaguuaugaaugcccaauguuagaugagggaguagaacccgaugacguagauugcuggugcaacacuacaagcacauggguaguauaugguacaugucaucauaaaaaaggcgaagcaagaagaagccgaagagcaguuacacuaccaucacauucaacaagaaaacuucaaacgcgaucacagacuuggcuagaaucaagagaauauacaaaacaucuaauuaggguagaaaauuggaucuucagaaacccaggauuugcgcuagcagcugcugcuauugcuugguuauuaggaucaucaacaagccaaaaaguaauuuaucuugugaugauucuacuaauugcacccgcauauucuauacgcugcauaggagugucgaaccgagauuuugucgaaggaauguccgggggaaccuggguagauaucguauuagaacauggagguuguguuacugugauggcacaagauaaaccaacaguagauauagaauuaguuacaacaacaguaagcaauauggcagaaguuagauccuacuguuaugaagcauccauuagcgauauggcuagugauagcagauguccaacacaaggagaagcuuacuuagauaaacaaagugacacacaauauguaugcaaaaggacauugguagaccgaggauggggcaauggaugcgguuuauucgguaaaggcucauuaguaacuugugcaaaauuugcguguucaaaaaaaaugacaggaaaaaguauacaaccagaaaauuuagaauacagaauaauguuaucaguacacggaucccaacacucaggaaugauaguaaaugacacaggacaugaaacagaugaaaacagagcaaaaguagagauaacaccaaauucaccaagagcugaagccacauuaggaggauucggaaguuuagguuuagacugugaaccaagaacuggauuagauuuuagcgacuuauauuauuuaacaaugaacaauaaacauugguuaguacauaaagaaugguuucaugauauaccauuacccuggcaugcaggagcugauacagggacuccccauuggaacaauaaagaagcacuuguagaauucaaggaugcacaugcgaaaagacaaacaguaguagucuuaggcagccaagaaggggcaguucacacagcauuagcaggagcuuuagaagcggagauggauggcgcaaaaggaagauuaagcucaggccacuuaaaaugcagguuaaagauggacaaauuaagauuaaaaggaguaaguuauagccuaugcacagcagcauuuacauucacuaaaauaccagccgaaacauuacacggaaccguuacuguugaaguacaauacgcaggaacagacggacccugcaaaguaccagcucaaauggccguagauaugcaaacauuaacucccguugggagacuaauaacagccaauccaguaauaacagaaaguacugaaaauucaaaaaugauguuagaauuagauccaccuuuuggagacucauacauaguuauagguguaggggaaaagaaaauaacacaccacuggcacagaucaggcucaacuauugguaaagcauuugaagcuacagucagaggcgcgaaaagaauggcaguacuaggagauacagcaugggauuucggaucaguuggaggggcauuaaacaguuuaggaaaaggaauacaucaaaucuucggagcagcuuucaaaucuuuauuuggagguaugucuugguuuucucagauacuaauagguacauuauuaaugugguuaggacuaaauacaaaaaaugggucaaucucuuugauguguuuagcacuagguggaguguugauauuuuuaucaacagcaguaagugcagacguagguuguucaguagauuuuucaaaa

SEQ ID NO: 2489 - RNA, 2133 nt, Artificial Sequence
  ZIKV prME variant CDS opt
auaauuaacgcuaggaaagaaaaaaaacgaagaggggcagauacauccguaggcauaguagguuuguuauuaacaacagccauggcagcagaaguaacacgaagaggcucagcauacuacauguauuuagauagaaaugaugcaggagaagcaauaagcuuuccaacuacauuaggaaugaauaaauguuauauacaaaucauggaucuaggacacaugugugaugcgacaaugucauaugaaugcccaauguuggaugaaggaguugaaccagaugaugucgauugcugguguaauacaacaaguacauggguaguauauggaacaugccaucauaaaaaaggagaagccagaagaagcagacgcgcaguaacacucccaucucauaguacaagaaaacuacaaacaagaucucaaaccuggcuagagagcagagaauacacaaaacauuuaauaagaguagagaauuggauuuucagaaauccuggauuugcccuggcagcagcagcuauugcauggcuacuugguucgagcacgagccaaaaaguaaucuaucucguuaugauacuacuaauagcuccagcuuacagcauaagauguauuggaguaucaaauagagauuuuguagaagguaugucaggaggaacauggguagauaucguuuuagaacauggaggauguguaacaguaauggcgcaagacaaaccaacgguagacaucgaauuaguaacaacgacaguaaguaauauggcagaaguaagaaguuacugcuacgaagcaaguauuucagauauggcaucagacucacgauguccaacacaaggagaagcauauuuggauaaacaaucagacacacaauauguaugcaaaagaacacuaguagacagaggaugggggaacggauguggacuuuuuggaaaagguucuuuaguaacaugugcaaaauuugcgugcucaaaaaagaugacaggaaaaaguauacaaccagaaaaucuugaauauagaauaauguuaucaguacacgggagccagcauagcggcaugauaguuaacgacacuggacacgaaacagacgaaaacagagcuaaaguagaaauaaccccaaauagucccagggcagaagcaacguuaggaggauuuggaaguuuaggacuagacugugaaccacgaacaggacuagauuuuagcgaucuauacuacuuaacaaugaacaacaaacacuggcuaguccauaaagaaugguuucaugacauaccguuaccauggcaugcaggagccgacaccggaacuccacauuggaauaacaaagaggcauuaguagaauuuaaagaugcacaugcaaaaagacagacuguaguaguacuaggaagucaagaaggagcuguacacacagcacuugcaggagcauuagaagcagaaauggacggagcaaaagggcgguugucauccggacaucuaaaaugucgauuaaaaauggacaaauuaaggcuuaaaggaguaucuuacagucuaugcacagcagcauuuacauuuacaaaaauaccagcagaaacauuacaugguacaguaacaguugaaguacaauaugcaggaacagauggcccauguaaaguuccagcacagauggcaguagauaugcaaacuuuaaccccaguaggaagauugauaacagcuaaucccguaauaacagaaaguacagaaaauucaaaaaugauguuagaacuggauccaccauuuggagauagcuauauaguaauaggaguaggagagaaaaagauaacacaucauuggcacagaaguggaagcacaaucggaaaagcuuuugaagcaacgguaaggggcgcaaaaagaauggcaguauuaggagacaccgcgugggauuuuggaagcguaggaggagcauuaaauaguuuaggaaaaggaauacaucaaaucuucggagcugcauucaaaucauuauuuggugguaugucaugguuuucacaaauacuaauagguacccuucuaaugugguuaggauuaaauaccaaaaacggcagcauaagcuuaauguguuuagcauugggugguguuuuaauuuuuuuaucuacagcaguuucagcagaugucgguuguagcguggauuuuagcaag

SEQ ID NO: 2490 - RNA, 2130 nt, Artificial Sequence
  ZIKV prME variant CDS opt
auaaaugcaagaaaagaaaaaaaacgaagaggagcagacacaagugucggaauaguagguuuauuauuaacuaccgcaauggcggcagaaguaacgagaagaggaucugcauauuacauguauuuagaucguaaugaugcuggagaagcaauaucuuucccaacaacacuaggaaugaauaaaugcuauauucaaauaauggaccuaggacauaugugcgaugcaacaaugaguuaugaauguccaauguuagacgaaggaguagaaccagacgauguggacuguugguguaauacaacuagcacguggguagucuacggaacaugccaucauaaaaaaggggaagcaagaagaaguagacgagcaguaacguuaccaucacauagcaccagaaaauuacaaaccaggucacaaacuuggcuagaaucacgagaauacacaaaacaucuaauuagaguagaaaacuggauauuucgaaacccgggauuugccuuagcugcagcagcaauagcauggcuauuaggaucaaguacuucacaaaaaguaauuuaucuaguaaugauacuauuaauagcgccagcauauucaauaagguguauuggaguuagcaauagagauuuuguagaaggaaugaguggaggaacuugggucgauaucguacuagaacauggaggauguguaacaguaauggcacaagacaaaccaacaguagauauagaacuaguuacaacaacaguaaguaauauggccgaagugagaagcuauuguuaugaagccucaauaucagauauggcaagugacucaagguguccaacucaaggagaagcauaucuggauaagcaaucagacacacaauaugucuguaaaagaacguuaguagauagagguuggggaaauggauguggucucuucggaaaaggaucauuaguaacaugugcaaaauuugccugcagcaaaaaaaugacaggaaaaagcauacaaccugaaaaccuggaauauagaauaaugcucucaguacaugguagccaacauucagguaugauagugaaugauacaggacaugaaacugaugaaaaucgagcaaaaguagaaaucacgccuaauaguccgagagcugaagcuacacuaggaggauuuggaaguuuaggauuagacugugaaccaagaacaggauuagauuuuagugaccucuacuauuuaacaaugaauaauaaacauuggcucguacauaaagagugguuucacgacauaccauuaccauggcacgcaggugccgauacaggaacuccgcauuggaauaacaaagaagcauugguugaauuuaaagaugcacaugcaaagagacaaacaguaguuguuuuaggaagccaagaaggagcaguccacacagcuuuagcaggagcuuuagaggcagaaauggauggagcaaaaggaagacuuagcucuggccaccuaaaaugcagauugaaaauggauaaacugagacuaaaaggaguaucuuauagucuauguacagccgcauucacauuuacuaaaauuccagcagaaacuuuacaugguacaguaacuguagaaguucaauaugcaggaacagauggcccuuguaaaguaccugcccaaauggccguagauaugcaaacauuaacaccaguaggaagauuaauaacagcaaauccaguaauaacagaaagcaccgaaaauagcaaaaugauguuagaauuagauccaccauuuggugauaguuauauaguaauuggaguaggcgaaaaaaaaauaacacaucacuggcauagaucagggucaacaauagguaaagcauuugaagccacaguaagaggagcaaaaagaauggcaguuuuaggagauaccgccugggacuuugguucaguaggaggagcucuuaauucuuuaggaaaaggaauacaccaaauauuuggcgcagcauuuaagaguuuauucggaggaaugucaugguuuucacaaauucuaauaggaacguuauuaauguggcuagguuuaaauacaaaaaaugggagcaucucccuaaugugucuugcauuaggaggaguacuuauauuuuuaagcacugcaguaagugcggacguagguuguaguguagauuuuagcaaa

SEQ ID NO: 2491 - RNA, 2127 nt, Artificial Sequence
  ZIKV prME variant CDS opt
aacgcuagaaaagaaaaaaaacguagaggugccgacacaagcguaggaauuguaggguuauuauuaacaacagcaauggcagcugaaguaacuagaagagguucagcauacuauauguacuuagauagaaaugacgcuggagaagcaauaaguuuuccaacaacauuagguaugaauaaauguuauauacaaauaauggaucuuggucauaugugcgaugccacaaugucguacgaauguccaaugcuagaugaaggagucgaaccagaugauguagauuguugguguaacacaacaagcacuuggguaguguaugguacaugucaucacaaaaaaggagaggcaagaagaaguagacgggcuguuacacuucccagccacucuacgagaaaacuacaaacacgaagucaaacauggcuagaaucaagagaauacacaaaacaccuaauaagaguagaaaauuggauauuuagaaauccaggguucgcucuugcagcagcagcaauagcauggcuauuaggaaguaguacuagucaaaaagugauauaucuaguaaugauacuuuuaauagcgccagccuacagcauaagauguaucggaguaaguaauagagauuuugucgaaggaaugucuggagguacuuggguagacauaguacuagaacacgguggaugcgugacuguaauggcacaggacaaacccacaguagacauugaauuaguaacaacaacaguaucaaacauggcagaaguaagaucauauuguuaugaagcaaguauaagugauauggcaucagauagucgauguccaacacaaggagaagcuuauuuagauaaacaaagugauacgcaauacguauguaaaagaacgcuaguagacagggguuggggaaacggaugugguuuauucgguaaggguucauuaguaacaugugccaaauuugcauguaguaaaaaaaugacuggaaaaucuauacaaccugaaaauuuagaauacagaauuauguuaucgguucauggaagccagcacagcggaaugauaguuaaugauacaggacaugaaacggaugaaaauagagcaaaaguagaaauaacaccaaacaguccaagagcagaagcaacauuaggaggauuuggaagcuuaggauuggauugugagccgagaacaggauuagauuuuagcgaucuauacuauuuaacaaugaauaacaaacauugguuaguacauaaagaaugguuucacgauauuccacuaccguggcaugcaggagcagauacagguacaccgcauuggaauaacaaagaggccuuaguugaguucaaagaugcucaugcuaaaagacaaacggucguaguacuaggaucacaagaaggagcaguacacacagcacuagcaggagcucuugaagccgaaauggauggugcgaaaggacgauuaucaaguggacauuuaaaaugcagacuaaaaauggauaaauugagauuaaaaggaguaaguuacagcuuauguacagcugccuuuacuuucacaaaaaucccagcugaaacauuacauggaacaguuacaguugaaguucaauaugcaggaacagaugguccauguaaaguaccagcacaaauggcaguagauaugcaaacauuaacuccaguaggaagauuaauaacugccaauccuguaaucacagaaaguaccgaaaauucaaaaaugauguuagaauuggauccgccauuuggagauucuuauauagucauagguguaggugaaaaaaaaauaacacaucauuggcauagaagugguucaacaauagguaaagcauucgaagcaacaguaaggggagcaaaaagaauggcaguacuaggagauacagcuugggacuuugguagcgucggaggugcuuuaaauagcuuaggaaaagguauucaucaaauauuuggugccgcauuuaaaaguuuauucggagggaugaguugguuuagucaaauacucauuggaacucuuuugauguggcuaggauuaaacacaaaaaauggaaguauuucacuaauguguuuagcauuaggaggaguauuaauauuccuaucuacagcagucucagcugauguaggaugcucagucgacuuuaguaaa

SEQ ID NO: 2492 - RNA, 2124 nt, Artificial Sequence
  ZIKV prME variant CDS opt
gcaagaaaagaaaagaaaaggagaggagcagacacaaguguaggaauaguagguuuauuacugacuacggcaauggcagcagaaguuacaagaaggggaagcgcauauuauauguauuuagauagaaaugaugcaggagaagcaauaucauucccaaccacauuaggaaugaacaaauguuacauacaaauaauggaccucggacauaugugcgaugccacaaugucauaugaaugcccgauguuagacgaaggaguagaaccagaugauguagauuguugguguaauacuacuagcacauggguaguauacggaacaugccaucauaagaaaggagaagcucgaagaucuagaagggcuguaacuuuacccucacauucaacacguaaauuacagacaagaagccaaacauggcuagaaucaagggaauauacaaaacacuuaauuagaguagaaaauuggauauucagaaauccaggauucgcguuagcagccgcagcgauagcuugguuauuaggaucaaguacaucucaaaaaguaauauaucuagucaugauacuacuaauagcgccagcuuacaguauaagaugcauaggaguaaguaacagagacuuuguagaaggaaugucaggaggcacauggguagacauaguacuagaacaugguggauguguaacagugauggcacaagacaaaccaacaguagauauagaauuaguaacaacgacaguaagcaauauggcagaaguaaggaguuauuguuaugaagcaucaauuucagauauggcaagcgauucaagaugucccacucaaggugaagcauaucuagauaaacaaagcgauacgcaauauguauguaaaagaacuuuaguagaucgaggcugggguaacggaugcgguuuauuuggaaaagggagcuuagucacaugugcaaaauucgcauguucgaagaaaaugacuggaaaaaguauacaaccugaaaaucuagaauacagaauuauguuaucaguacauggaagucaacauaguggaaugauuguaaacgauacaggucaugaaacggacgaaaaucgcgcaaaaguagaaauaacaccuaauaguccacgagcagaagcuacuuuaggggguuucgggucauuaggauuggacugugaaccaagaacagguuuagacuuuagugaccuauauuacuuaacaaugaacaauaaacacugguugguacacaaagaaugguuucaugacauaccauuacccuggcaugcaggagcagacacuggaacuccacauuggaauaauaaagaagcgcuaguagaauuuaaagaugcacaugcaaaaagacaaacuguaguuguccuaggaucacaagaaggagcaguacauacagcauuagcuggagcauuagaggcagaaauggauggagcaaaaggaagauuauccagugggcaucuaaaaugcagguuaaaaauggauaaacuuaggcuaaaaggaguaucuuacucacuauguaccgcugcauucacauuuacaaaaauuccugcagaaacauuacauggaacagugacaguagaagugcaauaugcuggaacugacgguccauguaaaguuccagcacaaauggcaguagauaugcaaacauuaacuccuguagguagacuuauaacagcaaacccaguaauaacagaaaguacagaaaauucaaaaaugaugcuagaauuagauccaccauucggagauagcuauauagugauuggaguaggugaaaagaaaauuacacaccacuggcacaggagugguaguacaauaggaaaagcguuugaagcaacuguaagaggugcaaaaagaauggcugucuuaggugacacugcaugggauuuugguaguguuggaggagcuuuaaauucacuaggaaaagguauacaccaaauauucggagcagcauuuaaaagucuauuuggcgguauguccugguuuucacaaauauuaauaggaacguuauuaaugugguuaggacuaaacacgaaaaauggaagcauaucauugauguguuuagcucuaggaggaguuuuaauauuucuuucaacagcagucucagcagauguuggauguucaguagacuuuaguaaa

SEQ ID NO: 2493 - RNA, 2121 nt, Artificial Sequence
  ZIKV prME variant CDS opt
agaaaagaaaaaaaaagacgaggagcagacacaucagucggaauuguaggacuacuuuuaacaacagcaauggcagcagagguuacuaggagagguucagccuauuauauguauuuagauagaaacgaugcuggcgaagcaauuaguuuccccacaacauuaggaaugaauaaauguuauauacaaauuauggauuugggucauaugugcgacgcaacaaugaguuaugaaugccccaugcuggaugaaggggucgaaccagacgauguagauuguugguguaacacaacaucaaccuggguaguauacgggacaugucaucacaaaaaaggagaagcgagacgaagcagaagagcaguuacacuaccaagucacucaacacgaaaacuacaaacacgaucacaaacaugguuagaaaguagagaguacacaaaacaucuuauucgaguagagaauuggauauuuaggaauccaggauuugcauuagcagcagcagcaauagcaugguuauuagguucaucaacaagucaaaaaguaauauaccuuguaaugauacuacuuauagcaccugcuuauaguauaagauguauuggaguaucaaauagagacuuugucgaaggaaugaguggaggcacguggguagauauaguauuagaacacggaggauguguaacagucauggcacaagacaaaccuacaguagacaucgaacucgucacuaccacaguaucaaauauggcagaaguaagaucauacuguuaugaagccaguauaagugauauggcaagugacucaagauguccaacacaaggugaagcauaucucgauaaacaauccgauacucaauauguauguaaaagaacauuaguagauagaggauggggcaauggauguggacuuuuuggaaaagggucacuaguaacaugcgcaaaauuugcauguaguaaaaaaaugacagguaaaucaauacaaccagaaaaccuugaauaucgaauaauguuaaguguucauggaagccaacacucgggcaugaucgugaacgacacagggcacgaaaccgaugagaauagagcaaagguagaaauaacaccaaauagcccaagagcagaagcuaccuuaggaggauucggaucauuaggcuuagauugugaaccaagaacaggguuagacuuuucagaucuauacuaucuaaccaugaauaauaaacauuggcuaguucacaaagaaugguuucaugauauaccauuaccauggcacgcaggagcagacacgggaacaccacauuggaacaacaaagaagcauuaguggaauuuaaagaugcacacgcaaaaagacaaacuguugugguacuaggaagucaggaaggagcaguacauacagcauuagcgggagcgcuagaagcagaaauggauggagcaaaaggaagacuaucaucuggucacuuaaaauguagauugaaaauggauaaguuaagauuaaaggggguuagcuauucucuauguacagcggccuucacuuuuacaaaaauuccggcagaaacacugcauggaacaguaacaguagaaguccaguaugcagguacagacggaccauguaaaguacccgcccaaauggcaguagauaugcaaacauugacuccaguaggaagacucauaaccgcuaauccgguuauaacagagaguacagaaaacucaaaaaugaugcuagaacucgauccgccauucggagauucguauauaguuauagguguuggagaaaaaaaaauaacacaccauuggcauagaucaggcuccacaauaggaaaagccuuugaagcuaccguaaggggagcaaaaagaauggcaguauuaggagauacugcaugggauuucggaucaguuggaggagcacuaaauagcuuaggaaaaggaauacaucaaauauuuggagcagcauuuaaaucuuuguuuggaggaaugucaugguucagucaaauauuaauaggaacguuauuaaugugguuaggucugaauaccaaaaauggaagcauuaguuuaauguguuuagcauuaggaggaguauuaauauuucuaucgacagcuguaucagcagauguggguuguucaguagauuuuuccaaa

SEQ ID NO: 2494 - RNA, 2118 nt, Artificial Sequence
  ZIKV prME variant CDS opt
aaagaaaaaaaaagaagaggagcagauacaucaguaggaaucguaggauuacuauugacaacagcuauggcagcagaaguaacaagaagaggaucggcauauuauauguauuuagaucgcaacgaugcuggagaagcaauuucauucccaaccacuuugggaaugaauaaaugcuacauacaaauaauggauuugggacauaugugugacgcgacuaugucauacgaguguccgaugcuagaugaaggaguagaaccugaugacguagauuguugguguaauacuacaagcacuuggguagucuaugguacgugccaucauaaaaaaggugaagcucgaagaagcagaagagcaguuacuuuaccuucacacucaacaagaaaauuacaaacgagaagucaaacaugguuagaaucaagagaauauacaaaacauuuaauaagaguugaaaauuggauauuuagaaauccugguuuugcauuagcugcggcagcaauagccugguuauuaggaucaucaacuagucaaaaaguaauuuauuuaguaaugauuuuauuaauagcaccugcguauaguauaagauguauaggaguaaguaauagagauuuuguagaagguaugucaggaggaacauggguagacauaguauuggaacauggggggugcguaacagucauggcucaagacaaaccaacaguagacauagaauuaguuacaacaacuguauccaauauggcagaaguaagaagcuauuguuacgaagcuucuauaagcgacauggcuucagauucaagauguccuacacaaggugaagcauauuuagacaaacaaagugauacccaauacguaugcaaaagaacauugguggauagaggaugggguaauggaugcggauuauuuggaaagggaucacuaguaacaugugcaaaauuugcauguagcaaaaaaaugacaggaaaaaguauacaaccggaaaaucuagaauauagaauaauguuaucgguacacgguagucaacauucaggaaugauaguaaaugauacaggacaugaaacagaugagaacagagcuaaaguugaaauuacaccgaauucuccaagagcagaagcaacgcuaggaggauuuggaagucuagguuuagauugcgaaccaagaacagguuuagacuucagugacuuauacuacuuaacaaugaacaauaaacauugguuaguacacaaagaaugguuucaugauauaccacuaccauggcaugcaggagcggauacuggaacaccacacuggaacaauaaagaagcauuaguagaauuuaaagaugcacaugcaaaaagacaaacaguaguagugcucgguucacaagaaggagcagugcacacagcauuggccggagcacuagaagcagaaauggauggagcaaaaggaagacuaucaucaggacaucuaaaaugcaggcuaaaaauggauaagcuuagauuaaaaggaguaucauauucacugugcacagcagcuuucacauucaccaaaauuccugcagaaaccuugcacgguaccguaacaguagaaguacaguaugccgggacagauggaccauguaaaguaccagcgcaaauggcggucgauaugcagacucuaacaccagugggaagguuaauaacagcuaaucccgugauaacagaaucaacagaaaauaguaaaaugauguuagaacuagauccuccauuuggagauucauacauaguaauaggaguuggagaaaaaaaaauaacacaucacuggcauaggagcggcucaaccauuggaaaagcauucgaagcuacaguaagaggcgcaaaacguauggcaguauuaggagauacagcaugggauuuuggaucaguuggaggugcauuaaacucacucggaaaaggaauacaucaaauauucggagcugcuuucaaauccuuguucggagguaugaguugguuuucucaaauauuaauaggaacacuauugaugugguuaggauuaaauacaaaaaacggaagcauaucauuaauguguuuagcauuagggggugucuuaauuuucuuaucaacagcagugucagcagaugucggguguagcguugauuuuaguaaa

SEQ ID NO: 2495 - RNA, 2115 nt, Artificial Sequence
  ZIKV prME variant CDS opt
gaaaagaaaagaagaggagcagauacaucagugggaauuguagggcuauuauuaacaaccgcaauggcagcagaaguaacaagaaggggaagcgcauacuauauguauuuagaccguaaugacgcuggagaagcgauuuccuuucccacaacauuaggaaugaauaaaugcuacauacaaauaauggacuuaggacauaugugugaugccacaaugucauacgaauguccaaugcuugacgaaggaguagaaccagaugacgucgacuguuggugcaauacaacaucuacuuggguuguuuaugggacuugucaucacaagaaaggagaggccagacgaagucguagagcaguaacuuuaccaagccacucaacaagaaaacuacagacuagaagucaaacgugguuagaaucaagagaauauacaaaacauuuaauacgaguggaaaacuggauauucagaaacccuggauucgcauuggcagcagcugcaauugcaugguuauuaggaucaaguacaucacaaaaaguaauauauuuaguuaugauauuacuaauugcacccgcuuauucaauaagauguauaggaguaucuaacagagauuuuguugaaggcaugagcggaggaacauggguagauauaguauuggaacaugggggaugcguuacaguaauggcacaagauaaaccaacaguggauauagaauuagucacaacaacaguuaguaacauggcagagguacgaucuuauuguuacgaagcaaguauaagugauauggcaucggauaguagauguccuacacaaggagaggcuuauuuagacaaacaaagugauacacaauauguuuguaaaagaacacuuguugauagagguugggguaacgguugcggauuauuugguaaaggcucacugguuacgugugcaaaauucgcauguagcaagaaaaugacuggaaaaaguauacaaccagaaaaucuagaauauagaauaauguuaaguguacacggaagccaacauucaggaaugauaguaaaugacacaggacacgaaacagacgaaaauagagcaaaaguugaaaucacuccuaauucaccaagagcagaagcaacacuaggagguuuuggaucucuaggccucgacugugaaccacgcacaggauuagacuuuucagacuuauacuaucuuacaaugaauaacaaacauuggcuaguacauaaagaaugguuccacgacauuccacuaccauggcacgcaggagcagacacaggaacaccacauuggaacaacaaagaagcacuuguagaauuuaaagaugcccaugccaaaagacaaacaguaguaguauuaggaucacaagaaggcgcuguacauacugcccuagccggcgcacuagaagccgaaauggauggcgcaaaaggaagacuaucaagugggcauuuaaaauguagacuuaaaauggauaaacugcgacuaaaaggaguaucguacucauuauguacggcagcuuuuacauuuaccaaaauaccagcagaaacacuacacggaacuguaacgguggaaguucaauacgcuggcacagauggaccuuguaaaguaccagcacaaauggcaguagacaugcaaacuuuaacaccaguaggaaggcuaauaacagccaacccgguaauaacugaaaguacagaaaauucaaaaaugaugcuagaauuagauccuccguucggagauagcuacauaguaauugguguaggagaaaagaaaauaacccaucauuggcaccgaaguggaucuacaaucggaaaagcauucgaagcaacaguaagaggagccaaaagaauggcuguacuuggggauacagcaugggauuuuggaucaguagggggagcgcucaauaguuuaggaaaaggaauacaucaaauauuuggagcagcuuuuaaaaguuuauuuggaggaaugaguugguucucacaaauauuaauagguacccuacuaaugugguuaggacuuaauacuaaaaauggaaguauaucauugauguguuuagcauuagguggaguucuaauauuuuuaucaacagcaguaagugcagauguagguugcucaguagacuucagcaaa

SEQ ID NO: 2496 - RNA, 2112 nt, Artificial Sequence
  ZIKV prME variant CDS opt
aaaaaaaggagaggagcggauacaucaguaggaauuguaggauuacuguuaacuacugcaauggcagcagaaguuacaagaagaggaagugccuauuauauguauuuggacagaaacgacgcaggagaagcaauaucauuuccaacaacauuaggaaugaauaaauguuauauacaaauaauggauuuaggacauaugugugaugccacaaugucuuaugaauguccuauguuagacgaaggaguagaaccugaugacguugauuguuggugcaacacaacaaguacuuggguaguauauggaacaugccaucacaaaaaaggggaagcaaggagaucaagaagggcaguuacauuaccaucucacucuacgagaaaauuacagacaagaucacaaacgugguuagaaaguagagaauauacaaaacacuugauacgagucgaaaauuggaucuuccggaauccagguuuugcgcuagcagcagcagcaauagcauggcuauuaggaaguucaacaagucaaaaaguaauauacuuagugaugauuuuguuaauugcaccugcguacaguauaagauguauaggagugucuaauagagacuuuguagaaggaaugucaggcggaacauggguagauauuguacuagaacacggaggaugcgugacaguaauggcacaagacaaacccacaguagauauagaauuaguaaccacaacaguaagcaauauggcagaaguaagaagcuauuguuaugaggcaaguauaucagauauggcaagugauucaagauguccaacucagggagaagcuuauuuagauaaacaaagcgacacacaauauguauguaaaagaacacuuguagacagaggauggggaaacgggugcgguuuauuuggaaaagguucauuaguaaccugugcaaaauuugcaugcucuaaaaaaaugacuggaaaaaguauacaacccgaaaauuuagaauauagaauaaugcuaaguguacacggaucacaacauucagggaugauaguaaaugauacgggacaugaaacagaugaaaauagagcaaaaguagaaauaacucccaacaguccaagagcagaagcgacacuagguggguuugguaguuuagggcuggacugcgaaccaagaacggguuuagacuuuucagauuuguauuaucuaacuaugaacaauaaacauugguuaguacauaaagagugguuucacgacauuccgcuuccauggcaugccggugcagacacaggaacaccacauuggaacaauaaagaagcauuaguagaauuuaaagaugcacaugcaaaaagacagaccguaguagucuuaggaagucaagaaggagcgguacacacugcacuagcaggagcacuagaagcagaaauggacggagcaaaaggaagacugucaaguggacaccuaaaauguagguuaaaaauggauaaacuaagauuaaaagguguuucauauucacuauguacagcagcauuuacauuuacgaaaauaccagcagaaacauuacacgguacaguaacaguagaaguacaguaugcaggaacagauggaccuugcaaaguaccugcacagauggcuguagauaugcaaacacuuacaccaguaggcagacuaauaacagcaaauccaguaauuaccgaaaguaccgaaaauucaaaaaugauguuagaacuugauccaccuuuuggagacagcuauauaguaauaggggugggagaaaaaaaaauaacacaccauuggcauagaaguggaaguaccauagggaaagcauuugaagcaacaguuaggggagcaaaaagaauggcgguauuaggggacacagcuugggacuuuggaaguguugguggagcauuaaauucauuaggaaaaggaauacaucaaauauuuggagcagcauuuaaaucauuauuuggagggaugaguugguuuagucaaauauuaauaggaacacuauuaaugugguuaggguuaaauacuaaaaauggcaguauaagcuuaauguguuuagcacuagggggagugcuaauauuucuaaguacagccguaagugcagacgucggaugcaguguugauuuuuccaaa

SEQ ID NO: 2497 - RNA, 2109 nt, Artificial Sequence
  ZIKV prME variant CDS opt
aaaagaagaggugcagacacgaguguuggaauagugggauuguuacuaacaacagcaauggcugcagagguuaccagaagaggaucugcauauuauauguauuuagacagaaacgaugccggugaagcaauaaguuucccaacgacucuaggaaugaauaaaugcuacauacaaauuauggacuuaggacauaugugcgaugcaacaaugagcuaugaaugcccaauguuagaugagggaguagaaccagacgauguagauuguugguguaauacaacaucaacuuggguaguuuacgguacuugccaucauaaaaaaggagaagcaagaagaucaagaagagcaguaacauugccuagucauucaacacgcaaacuccaaacaagaucacaaacaugguuggaaucaagagaauacacaaaacauuuaauaagaguagaaaauuggaucuuucgaaauccaggauuugcacuagcagcagcagcaauagcaugguuauuaggaaguucuacaucacaaaaaguaauauaccuagucaugauacucuugauagccccugcauauucuauaagaugcauaggaguuaguaauagagauuucguugaaggaauguccggaggaacuuggguugauauagucuuagaacacggaggauguguaacuguaauggcacaagauaaaccaacuguagauauagaauuaguuacaacaacaguaucuaauauggcagagguacgaucauacuguuaugaggccaguauaagugauauggcauccgacucacgauguccaacacaaggagaagcuuaccuugauaaacaaagugauacgcaauauguauguaaaagaacauuaguagaucgaggauggggcaauggcugcggauuauuuggcaaaggauccuuaguaacaugugcaaaauucgcauguagcaaaaaaaugacaggaaaaucaauacaaccagaaaauuuagaauauagaauaaugcuaucaguacauggaucacaacauagcggaaugauaguuaacgauaccggacaugaaaccgacgaaaauagagcaaaaguagaaauaacaccaaacagcccaagggcagaagcaacauuaggcggauuuggauccuuagguuuagacugugaaccacgcacugguuuggauuuuagugauuuauacuaccuuacaaugaacaauaaacauugguuaguccacaaagaaugguuucaugauauaccauuaccauggcaugcuggugcagauacugggaccccacauuggaauaauaaagaagcauuaguagaguuuaaagaugcacaugcaaaaagacaaacagucgucguccuagggagucaagaaggagcaguacacacagcacuagcaggagcccuugaagcagaaauggacggagcaaaaggaagauuaaguucaggacauuuaaagugucgccuuaaaauggacaaauuaagacuaaaaggagucaguuauucgcuauguaccgcagcguucacguuuacaaaaauuccggcagaaacucuacaugguacuguuacuguagagguccaauaugcaggcacagacggaccauguaaaguaccagcucaaauggccgucgacaugcaaacacucacuccaguaggaagauuaauaacagcaaauccaguaauuacagaaucaacagaaaauaguaaaaugauguuagaauuggauccacccuuuggagacaguuauauuguaauaggagucggagaaaaaaaaauaacacaucauuggcaucgaucaggaucaacgauaggaaaagcauuugaggcaaccgucagaggagcuaaaagaauggcaguucuaggagacaccgcaugggauuucggaucagucggaggggcacuaaauucucucgguaaagggauacaucaaauauuuggagccgcauuuaaauccuuauucggagguaugaguugguuuucacaaauccuaauaggaacauugcuaauguggcugggacuaaauacgaaaaaugguaguauaucauugaugugcuuagcucuaggagguguauuaaucuuucuuagcacagcaguuucggcagacgucggauguaguguagauuucaguaaa

SEQ ID NO: 2498 - RNA, 2106 nt, Artificial Sequence
  ZIKV prME variant CDS opt
agaagaggagccgacacuucagugggaauuguaggauuauuauuaacaaccgcaauggcagcagaaguuacaagaaggggaucagcauauuauauguaucuugauagaaaugacgcaggugaagccauuaguuuccccacaaccuuagguaugaauaaaugcuauauacaaauaauggauuuaggacauaugugugaugcaaccaugaguuacgaaugcccaauguuagacgaagggguugaacccgaugauguagauugcugguguaacacuacaaguacauggguaguauauggcacaugucaucacaaaaaaggugaagcaagaagaucaagacgagcaguuaccuuaccuagccauaguacacgcaaauuacaaacaagaucacagacuugguuagaaaguagggaauauaccaaacacuuaauaagaguugaaaauuggauauuuagaaaucccggauuugcauuagcagcagcagcaauagcgugguuacuaggcagcucaacuagucaaaaaguaauauaucuaguaaugaucuuauuaauagcuccagcauauucaauaagauguauaggagugagcaauagagauuuuguagaaggaaugaguggagguacauggguagacauaguacuagaacacggaggcuguguaacagucauggcacaagauaaaccaacaguugauaucgaauugguaacaacaacaguaagcaacauggcggaaguaagaagcuacugcuaugaagcuaguauaagcgacauggcaagugauucaagauguccuacacaaggagaagcguaucuagauaaacaaagugauacacaauauguuuguaaaagaacauuaguagauagaggauggggaaauggauguggauuguuugguaaagggucauuggucacuugcgcuaaauuugcauguaguaaaaaaaugacaggaaaaagcauucaaccagaaaaccuagaauauagaauaaugcuuaguguccauggaucacagcauucagguaugauaguaaaugacacaggacaugaaacagacgaaaauagagcaaaaguagaaauaacaccgaacagcccaagagcagaagcuacuuuaggaggauuuggaaguuuaggacuagacugugaaccaagaacaggcuuagauuuuagugacuuauauuauuugacgaugaauaauaaacacugguuaguacacaaagaaugguuccaugauauaccauugccauggcaugcaggugcagauacaggaacaccacacuggaauaacaaagaggcccugguagaguucaaagaugcacaugcaaaaaggcaaacaguuguaguauuaggaucucaagaaggugcaguucacacugcccuagccggagcauuagaagccgaaauggauggagcuaaaggaagauugaguagcggacaucuuaaaugcagauuaaaaauggauaaauuaagacucaaagguguaagcuauaguuuauguacagcagccuuuacauuuacuaaaauacccgcagaaacacuacauggaacaguuacaguugaaguacaauacgcaggaacggaugguccauguaaaguaccugcucaaauggcaguagacaugcagacacuaacgccgguagguagauuaauaacagcgaaucccguuauaacugaaucaacagaaaauucaaaaaugaugcuagaauuagauccaccuuuuggagacagcuauauaguaauaggaguaggagaaaaaaaaauaacacaucacuggcauagaucaggcagcacaauugguaaagcuuuugaagcuacaguucgaggagcaaaaagaauggcaguacuaggagauacagccugggauuuuggaagcguagguggagcuuuaaacucuuugggaaaagguauacaucaaauuuuuggagcugcuuuuaagaguuuguuugguggaaugucgugguuuagucaaauauugauaggcacauuacucaugugguuaggacuaaauacaaaaaacggaucaauaagucuaauguguuuagcacuaggaggaguauuaauauuuuuaucuacagcaguaagcgcagacguuggauguucaguagauuucaguaaa

SEQ ID NO: 2499 - RNA, 2103 nt, Artificial Sequence
  ZIKV prME variant CDS opt
aggggagcagauacaucaguaggaauaguaggauuauuauuaacaacagcaauggcagcagaaguuacaaggaggggaagugccuacuacauguacuuagauagaaacgaugcaggagaagcaauuaguuuuccuacaacauuaggaaugaauaaaugcuauauacaaauaauggacuuaggucauaugugcgacgcaacuaugucuuacgaaugcccaauguuagaugaaggaguagaaccagacgauguagacuguugguguaauaccacaaguacguggguaguauauggaacuugucaucacaagaaaggagaagcaagaagauccaggagagcaguaacuuuaccaucacacucaacgagaaaauuacagacaagaagccaaacaugguuagaaucaagagaauauacaaaacacuuaaucagaguagaaaauuggauauuucgaaauccaggauucgcacuugcggcagcugcuauagcauggcucuuaggaaguucuaccagccaaaaaguaauuuauuuaguaaugauacuuuuaauagcacccgcauauucaauaagguguaucggaguuucuaauagagauuuuguggaaggaaugucaggcggaacuuggguggacaucguuuuagaacacggaggauguguuacaguaauggcucaagauaaaccaacuguagauauagaauuaguaacuacgacagugucaaauauggcagaaguaagaucuuauuguuaugaggcuucaaucagugacauggcaucagauaguagauguccaacacaaggagaagcauauuuagacaaacaaagugacacacaauaugucuguaaaaggacauuaguagacagaggguggggaaauggauguggacucuuuggaaaaggaucucuaguaacuugcgcuaaauuugcauguucaaagaaaaugacaggaaaaucaauacaaccagaaaaucucgaauauagaauuauguuaucaguacauggcucacaacauaguggaaugauaguuaaugauacaggacaugaaacagaugaaaacagagcaaaaguagaaauuacaccuaacucaccuagagccgaagccacacuaggugguuuuggaaguuuaggacuagauugugaaccaaggacaggucuagauuuuagcgacuuauauuauuuaacaaugaauaauaaacauugguugguccauaaagaaugguuccacgauauuccauuaccuuggcaugcaggagcagauacaggaacaccacauuggaauaacaaagaagcauuaguugaauuuaaagaugcacaugcuaaaagacaaacuguaguuguacuuggaucccaagaaggagcaguucauacagcauuagcgggugcacuugaagcagaaauggauggagcaaaagguagacuaucaagcggacaucugaaaugucgacuaaaaauggauaaacugagauugaaaggaguuaguuauaguuuaugcacagcagcauucacauuuacaaaaaucccagcagaaacauuacauggaacaguaacuguagaaguacaauaugccggaacugauggacccuguaaaguucccgcacagauggcgguagacaugcagacauuaacuccaguagguagauuaauaacggcaaauccugucauaacggaaucuacagaaaauucaaaaaugauguuggaauuagacccaccauuuggagauuccuacauaguuauaggagucggugaaaagaaaauaacacaucauuggcacaggagcggaaguaccauugguaaggcuuuugaagcaacaguaagaggagcaaaaagaauggcaguuuugggagauacagcaugggauuucgguaguguuggaggagcucuuaauucuuuaggcaaaggaauacaucaaauauucggagcagcuuuuaaaagucuauucggagggaugaguugguuuagccaaauacuaauuggaacgcuacugaugugguuaggacucaacacuaaaaacgggagcauuaguuuaaugugccuagcauuagguggaguacuaauauuucuaucaacagcaguuucagccgaugucggcuguucaguagauuuuuccaaa

SEQ ID NO: 2500 - RNA, 2100 nt, Artificial Sequence
  ZIKV prME variant CDS opt
ggugcagauacaucaguuggaauaguaggacugcuauuaacaacagcaauggcggcagaaguaacaagacggggaucagcuuauuacauguaucuagauagaaaugaugcaggagaagcaauaucauucccaacgacacuaggaaugaacaaauguuacauccaaauaauggaccuaggacauaugugcgacgccacuaugagcuaugaaugcccaaugcuagaugaaggaguagaaccggaugauguugacuguugguguaauacgacaucaacuuggguaguauacggaacuugucaucauaagaaaggagaagcaagacgaaguagacgagcaguaacacuaccaucacacaguacaagaaaauuacaaacaagaagucagacauggcuugaaagcagagaauauacaaaacauuuaauaagaguagaaaauuggauuuuuagaaauccagguuucgccuuagcugcagcugcgauagcauggcucuugggaucuagcacuucacaaaaaguaauauacuuaguaaugauuuuacuaauugcaccagcauauucaaucagauguauuggagucagcaauagggacuuuguagaaggcaugucagguggaacguggguagauaucguacuagaacacggagggugcguaacaguaauggcacaggauaaaccaacgguagacauagaauuaguaacgacaacgguaucaaauauggcagaaguaagaaguuacuguuacgaggcaucuauuagugacauggcuucagacucacgauguccaacacaaggagaagcauauuuagauaaacaaagugauacgcaauacguaugcaaaagaacauuaguagacagagggugggguaauggaugcgguuuauuuggaaaaggaucauuaguaacaugugcaaaauuugcauguucuaagaaaaugacaggaaaaaguauccaaccagagaauuuagaauacaggauuauguuaaguguacacggaucacaacauucagggaugauaguaaaugacacaggacaugaaacugaugaaaaucgagcaaaaguagaaauaacucccaauucaccaagagcugaagcuacauuagggggauuuggaucacuaggacuagauugugaaccgagaacaggauuagauuuuagugauuuauauuauuuaacaaugaacaauaaacacugguuaguacauaaagaaugguuucaugacauaccauuaccguggcacgcaggggcagauacuggaacaccacauuggaauaauaaagaggcacugguugaguucaaagacgcucacgcaaaaagacaaacaguagucguguuaggcucucaggaaggagcaguacauaccgcguuagcaggcgcacuagaagcagaaauggauggcgcuaaaggcagacuuagcagcggacacuugaaaugcagacuaaaaauggacaaauuacgguuaaaaggcgugaguuauucauuauguacagccgcauucacauucacaaaaauaccugcugaaacuuuacaugggacagugacgguagaaguacaguaugcggggacagacggaccuuguaaaguaccugcacaaauggcaguagauaugcaaacuuuaacaccaguaggaagauuaauaacagcaaauccaguaauuacagaaaguacagaaaauaguaaaaugaugcuagaauuagacccaccuuuuggcgacucauauauagucauaggaguaggugaaaagaaaauaacacaccauuggcacaggaguggaucuacaauaggaaaagcauuugaagccacaguaagaggagccaaaagaauggcaguacuaggagacacagcuugggauuuuggaagcgucggaggagcacuaaauaguuuaggaaaaggaauacaucaaauauucggagcagccuucaaaucauuauuuggugguauguccugguuuagucaaauauuaauaggaacauuauuaaugugguuaggacuaaauacuaaaaacgguaguaucucacuuauguguuuagcccuggguggaguauuaauauuuuuaucaaccgcuguaucagcugauguuggauguucaguagauuucucaaaa

SEQ ID NO: 2501 - RNA, 2097 nt, Artificial Sequence
  ZIKV prME variant CDS opt
gcagauacauccguaggaauaguaggacuuuuauuaacaacagcaauggcagcggaaguaacaagaagagguucagccuauuacauguauuuggauaggaaugacgcaggagaagcaauuagcuucccuacaacacuugggaugaacaaauguuauauacaaaucauggaccuaggacauaugugugaugcaacuaugaguuacgaauguccaaugcuugaugagggaguagaaccagacgacgucgauuguuggugcaauacuacaaguacuuggguaguauaugguacaugucaucauaaaaaaggagaagcaagacgcucaaggagagcaguaacauuaccuagucacucaacaagaaaacugcaaacacgaagucaaacauggcucgagagccgagaauauacaaaacaucuaauuagaguagagaacuggauauucagaaauccaggauucgccuuagcggcagcagcaauagcaugguuacuaggaaguucaacaucacaaaaaguaauauaucuagucaugauuuuauuaauagcuccugcauauucuauacgauguauaggagucaguaauagggauuuuguagaaggaaugaguggagguaccuggguagauauuguauuagaacacggaggcuguguaacuguuauggcacaagauaaaccuacaguagauauagaacuaguaacgacaacagugagcaacauggcugaagugagaucauauuguuaugaagcuagcauaagcgauauggccagugauucuagauguccaacccaaggagaagcauacuuagauaagcaaucugauacccaauauguaugcaaaagaacacuaguagaccgaggauggggcaauggaugcggucuauucggaaaaggaagcuuagugacaugugcaaaauuugcauguuccaaaaaaaugacaggcaaaagcauacaaccagaaaauuuagaauacaggauaaugcuaucaguacauggaucucaacauagcggaaugauaguaaaugauacaggacacgaaacugacgaaaauagagccaaaguagagaucacacccaacaguccaagagcagaagcaacgcuaggaggauuuggaagccucggauuagauugugaaccaagaacaggacuagauuucagcgaucuuuacuauuuaaccaugaacaacaaacauugguuaguacauaaagagugguuucaugauauaccguuaccuuggcaugcaggagcagauacaggaacaccacacuggaauaauaaagaagcccuuguagaauuuaaagacgcacaugcaaaaagacaaacgguaguuguauuagguagucaagaaggagcaguacauacagcacuagcuggugcauuagaagcagaaauggacggagcaaaaggaagauuaagcagcggacaucuaaagugcagacuaaaaauggauaaacuucgccuaaaaggaguaucauacucauuauguacugccgcuuuuacauucaccaaaauaccugcugaaacuuuacacggaacagucacuguagaaguacaauaugcagguacagaugguccauguaaagugcccgcucaaauggcaguagauaugcaaacacuaacaccuguaggaagauuaauaacagcaaacccuguaauaacagaaucaacagaaaacucgaaaaugaugcucgaacuagacccaccguuuggagauaguuacauuguaauugguguaggagaaaaaaaaauuacacaucauuggcaccguucagggaguacuauaggaaaagcauuugaagcaacuguaagaggagcaaaaagaauggcaguauuaggugauacagccugggacuucgguaguguaggaggagcauugaacucccuaggaaaaggcauucaucaaauauuuggagcagcauuuaaaaguuuauuuggaggaaugucaugguuuagucaaauauuaauaggcacgcuacuuaugugguuaggacuaaauacaaaaaacggaaguauuagccuaaugugcuuagcuuuagggggcguguuaauuuuuuugagcacagcaguuagcgcagacguaggauguaguguugauuuuucaaaa

SEQ ID NO: 2502 - RNA, 2094 nt, Artificial Sequence
  ZIKV prME variant CDS opt
gacacuaguguaggaauaguaggucuacuacuaacaacagcaauggcagcagaaguuacucgaagagguagcgcauauuauauguauuuagauagaaaugacgcaggagaagcuauaaguuucccaacaacacuaggaaugaacaaauguuacauucaaauaauggaccugggacauaugugcgaugcaaccaugucuuacgaauguccuaugcuugacgaaggaguagaaccugaugauguugacuguugguguaauacaaccagcacuuggguaguauauggaacaugucaucauaaaaaaggggaagcaagacgaucaagaagggcagugacauugccaagucacucaacuagaaaauuacaaacuagaucacaaacaugguuggaaucaagagaauacacaaaacauuuaauuagaguggaaaauuggauauuccgaaacccaggauucgcauuagcggcagcagcaauagcuugguuauugggaagcucaacgagucaaaagguuauauaccuagugaugauacuauuaauagcuccagcauauuccauaagaugcauaggaguaaguaaccgagacuuuguagaaggaaugaguggaggaacauggguagauauaguauuggaacauggaggauguguaacaguaauggcacaagauaaaccaacaguagauauagaacuaguuacaacaacaguuucaaauauggccgaaguaagaucguacuguuaugaggcuagcauaucagacauggcaucugauucaagauguccaacucaaggcgaagcauacuuagauaaacagagugacacgcaauauguaugcaaaagaacacucguggauagaggaugggguaacggguguggccuguucggcaaagguagucuaguaacaugugcuaaauuugcuuguucaaaaaaaaugacaggaaaaucaauacaaccggaaaaccuagaauacagaauaauguuaaguguccacgggagucaacauucaggaaugauuguuaaugauacaggucaugagacugaugaaaauagagcaaaaguagagaucacaccaaauucaccacgagcagaagcaacacuaggugguuuuggaaguuuaggauuagauugugaaccaagaacaggauuagauuuuucagacuuguauuacuuaacaaugaauaauaaacacugguuaguccacaaagaaugguuucaugauauuccacugccauggcaugcaggagcagauacaggcacaccacacuggaauaacaaagaagcauuaguugaauuuaaagaugcacacgcuaaaagacaaacaguagucguauuaggaagucaagaaggagccguucacacagcacuagcaggugcauuagaagcugaaauggacggagcuaaagguagauuaucaaguggacaccuaaaaugcagacugaaaauggacaaauuaagacuaaaaggaguaaguuauagcuuauguacagcggcauuuacauuuacaaaaauaccggcagaaacauuacaugguacaguaacuguagaaguacaauacgccggaacagauggaccaugcaaaguaccugcucaaauggccgucgauaugcaaacccuaacaccgguuggaagacucauaacagcaaauccaguaauaacagagucaacagaaaauaguaaaaugauguuagaauuagacccaccauuuggugacucguacauagugauaggaguuggugaaaaaaaaauaacacaccauuggcacagaaguggaagcacuauuggaaaagcauuugaagcaacuguuagaggcgcaaaaagaauggcaguucuuggagauacagcaugggauuuuggaaguguuggaggagcauuaaacaguuuaggaaaaggcauacaucaaauuuuuggagcagcuuuuaaaucacuauuuggaggaaugucaugguuuucacaaauauuaauugguacuuuacuaaugugguuaggacuaaauacuaaaaaugguaguauaaguuuaaugugucuagcauuaggcggagucuuaaucuucuuaucaacagcaguaagcgcagacguaggguguaguguagacuucucaaaa

SEQ ID NO: 2503 - RNA, 2091 nt, Artificial Sequence
  ZIKV prME variant CDS opt
accagcguuggaauaguagguuuacuauuaacaaccgcaauggcagcagaagugacaagaagaggaagugcauacuauauguacuuagaucguaacgaugcaggugaagcuauaucuuuuccaacaacguuaggaaugaauaaauguuacauacaaauaauggacuuaggacauaugugugacgcaacuaugucauaugaauguccaauguuagaugaaggaguugaaccagacgacguagauuguugguguaauacuaccaguacauggguaguauauggaacaugccaucauaaaaaaggagaggcuagaagaaguaggagagcaguaacauuaccaucucauucaacaagaaaacuucaaacacgaucacaaaccuggcuagaaagccgagaauacacaaaacaucuaauacgaguggaaaauuggauauuuagaaauccaggauucgcacuagcugcagccgcuaucgcauggcuacuagguaguucaacaucacaaaaaguaauuuacuuaguaaugauccuacucauugccccggcauauucaauaagaugcaucgggguuagcaacagagacuuuguugaaggcaugucgggaggcacauggguagauauuguacuugagcacggagggugcguaacuguuauggcucaagauaaaccaacaguugacauagaacuaguaacaacaacaguaucaaacauggcggaaguaagaaguuauugcuaugaagcaagcauaucugacauggcaucagauucuagauguccaacacaaggagaagcuuauuuagauaaacaaucagacacacaauacguauguaaaagaacauuaguagacagaggcuggggaaauggauguggauuguuuggaaaaggaucauugguaacaugugccaaauucgcauguaguaaaaaaaugacuggaaaaaguauccaaccagaaaauuuagaauaucgaauuauguuaagcguccaugguucccaacauucagguaugauaguaaacgauacaggacacgagacugaugaaaauagagcaaaaguggaaauaacuccaaauaguccaagagcagaagcaacuuuaggugguuuuggaucccucggauuggauugugaaccaagaaccggauuagacuucagugaucuauacuacuuaacaaugaauaauaaacacuggcuuguccacaaagaaugguuccacgacaucccauuaccauggcacgcaggcgcagauacaggcaccccacauuggaauaauaaagaagcacuaguagaauucaaagacgcacaugcaaaaagacaaacgguaguaguauuaggaagucaagaaggagcuguacauacagcccuagcuggagcacuagaagcagaaauggacggagcaaaagguagauuaaguaguggacaccugaaaugcagauuaaaaauggauaaacuaagguuaaaaggaguuagcuauucuuuauguacugcagcauuuacauucacuaaaauaccagcagaaaccuuacauggaacagugacaguagaaguacaauaugcaggaacugauggaccauguaaaguaccagcacaaauggcaguugauaugcaaacauuaacuccaguagggagacuuauaacagcaaauccaguaauaaccgaaucaacagaaaauagcaaaaugauguuagaauuagacccaccuuucggcgacagcuacauagucauaggaguuggugaaaaaaaaauaacccaucauuggcauagaaguggaagcacaauaggcaaagcauuugaagcaacugucagaggggccaaaagaauggcaguucuaggagauaccgcaugggacuucggaaguguaggaggagcacuaaacaguuuaggaaaaggaauacaucagauauuuggggcagcauucaaaagucuauuugggggcaugagcugguuuucacaaauuuuaauuggaacauuguuaauguggcuaggauuaaauacaaaaaaugguagcauaagcuuaaugugucuagcucuaggaggaguacugauuuuuuuaagcacagcuguuagugcugauguaggguguucuguagauuuuucaaaa

SEQ ID NO: 2504 - RNA, 2091 nt, Artificial Sequence
  ZIKV prME variant CDS opt
acaaguguugguauagugggguuauuauuaacgacugcaauggcagcagcaguaacaagaagaggaucagcuuauuauauguauuuagacagaaaugaugcaggggaagcaaucucauuucccaccacucuagguaugaauaaauguuauauucaaauaauggaucucggucauaugugugaugcuacuaugaguuaugaauguccaauguuagaugaaggaguugaaccagaugaugucgacuguuggugcaauacaacaaguacuuggguaguauauggaaccugucaucauaagaaaggagaagcuagacguaguaggagagcaguaacacuuccaagucauucaacaagaaaacuacaaacuagaagccaaacaugguuagaaaguagagaauauacaaaacaccuaauaagaguagaaaacuggauuuuuagaaacccaggauuugcccuggcagcugcugcuauagccugguuacugggauccaguacaucacaaaaaguaauauacuuaguaaugauauuauugauagcucccgcuuauagcauaagauguauuggcgucucuaauagagauuucguagaagggaugaguggugggacauggguagauauaguauuagaacacggagguugcguaacaguaauggcacaagacaaaccaacaguagauauagaauuagugacaacaacagugagcaauauggcugaaguacgaucauauugcuaugaagcaucaaucucagauauggcuucagacucaagauguccaacgcaaggagaagcauaucuagacaaacaaagugauacacaauacguauguaaaagaacauuaguagauagagguugggguaaugguuguggacuauuuggaaaaggcuccuuaguuacaugugcuaaauucgcuugcuccaagaaaaugacaggaaaaucaauacaaccugaaaaucuugaauacagaauaaugcuaaguguacauggaagccaacauagugggaugauaguaaaugauacgggacaugaaacugaugaaaauagagcaaaaguagaaauaacuccaaauagcccaagagcagaagcaacuuuaggcggauucggcagccuuggauuagauugugaaccaagaacaggcuuagauuuuagcgacuuauauuacuuaacaaugaauaacaaacauugguuaguccauaaagaaugguuucacgauauaccauuaccauggcaugcgggugcugauaccgguacaccacauuggaauaacaaagaagcauugguagaguucaaagacgcacacgcaaaaaggcaaacagucguagucuugggaagccaagaaggagccguacauaccgcauuagcaggagcacuagaagcagaaauggacggagcaaaaggaagauuaagcaguggacauuuaaaaugucgauuaaaaauggauaaacuuagauuaaaaggagucucauauucacuuuguacagcagcauuuacuuuuacaaaaauaccugcagaaacauuacaugggacagugacaguggaaguacaauaugcaggaacagauggaccauguaaaguaccagcucaaauggcuguugauaugcaaacacuaacaccaguaggacgacuaauaacugcuaauccaguaauaacagaaucaacugaaaauagcaaaaugaugcuagaacuugacccgccuuuuggugacaguuauauaguuauaggugucggugaaaagaaaaucacacaucacuggcauaggagugggucaacaauagggaaagcguuugaagcaacagucaggggugcaaaaagaauggcuguacuaggagauacagcaugggauuuuggaaguguaggaggggcauugaauagucuaggaaaagguauacaucaaauauuuggggcagcauuuaaaagucuauuuggcggaaugucaugguuuucacaaauucuaauaggaacuuuacuuauguggcucggauugaauacgaaaaauggaucaaucagcuuaauguguuuagcuuuaggaggugugcuaauauuuuuaaguacagccguaucagccgauguaggauguucuguagauuuuaguaaa

SEQ ID NO: 2505 - RNA, 2103 nt, Artificial Sequence
  ZIKV prME variant CDS opt
agaggagcagauacaaguguugggauaguaggacugcuucuaacuacugcaauggccgcugcgguaacgagacgaggaagugcauauuacauguauuuagacagaaacgaugcaggagaagcuauaaguuuuccaacaacgcuagguaugaacaaaugcuacauacagauaauggaucuaggacacaugugugacgcaacuaugucauacgaaugcccaauguuagaugaagguguagaaccagaugaugucgacuguuggugcaacacaacuucgacauggguaguauauggaacaugucaucauaaaaaaggagaagcacgccgaucaagaagggcagucacauuaccaucacacaguacaaggaaauuacaaacaagaagucaaacauggcuugaaucaagagaauauacaaaacacuuaauuaggguagaaaauuggauuuucagaaauccaggauuugcauuagcagccgcagcaauagcuugguuauuaggaaguaguacaagccaaaaaguaauuuauuuaguuaugauacuuuuaauagcuccagcauauucaauacgauguauagguguaucaaacagagauuuuguugaaggaaugaguggaggaacauggguagauauaguucuagaacauggagguuguguaacaguaauggcacaggacaaaccaacaguagacauagaauuaguaacaacaacaguuucaaauauggcagaaguaagaucuuauuguuacgaagcaaguauaagcgauauggcuagcgauucacgaugucccacacaaggagaagcuuaucuagauaaacaaucagauacacaauacguauguaaacgaacauugguagacagaggauggggaaauggauguggauuauuuggaaaagguagccuaguaacaugcgcaaaauucgccuguaguaaaaaaaugacaggaaaaucaauucaaccagaaaacuuagaauauagaauaaugcuauccguucacggcucgcaacauucagggaugauuguaaaugauacaggacaugaaacagaugaaaacagggcuaagguagaaauaacucccaauucaccaagagcugaagcaacauuaggcggguuuggaucacucggucuagacugugaaccacgaacuggauuagauuuuucagaucucuacuaucugacuaugaauaauaaacauugguuaguccauaaagaaugguuucacgauauaccacuacccuggcaugcaggugcagauacuggaacaccucacuggaauaauaaagaagcucuuguagaguuuaaagaugcacaugcaaaaagacaaacaguaguaguauuaggaagucaagaaggagcaguacacacagcauuagccggugcucuagaagcagaaauggacggagcaaaaggcagacucucaaguggacauuuaaaaugucgauuaaaaauggacaaauuaagguuaaaagguguaaguuacagucuauguacagcugcauuuacauuuacaaaaauaccugcugaaacgcuccauggaacagucacaguugaaguccaauaugccggaaccgauggcccauguaaagucccugcacaaauggcgguagacaugcaaacauuaacaccaguugguagauuaauaaccgcaaauccgguuauaacagaaaguacagaaaauuccaaaaugauguuagaauuagauccaccauuuggagacuccuauauaguaauuggaguaggagaaaaaaaaauaacacaucauuggcacagaucagguucaacaauaggaaaagcguucgaagcgacagugagaggagcaaaaagaauggcuguauuaggagauacagcuugggacuuuggguccguaggcggugcacuuaauucacuuggaaaaggcauacaucaaauuuucggggcggcuuuuaaaucacuuuucggaggaaugucaugguuuucacagauauuaauaggaacauuauuaaugugguuaggacuuaauacaaaaaauggaagcauuaguuuaaugugccuagcgcugggagguguacuuauauuucuuucaaccgcaguaagugcugauguaggguguucuguagacuuuuccaaa

SEQ ID NO: 2506 - RNA, 2127 nt, Artificial Sequence
  ZIKV prME variant CDS opt
agaggacugucaucgagaaaaagaagaagccaugauguccuaacaguucaauuucuaauauuagggauguuacuaaugacgggaggaguaacuagacguggaucagcauauuauauguaccuagauagaaacgaugcuggugaagcaauaucauuuccaacaaccuuaggaaugaauaaauguuacauucaaauuauggauuugggucauaugugcgaugcaaccauguccuaugaauguccaauguuagacgaaggaguggaaccagaugauguagauuguuggugcaauacaacgucaacuuggguaguauauggaacuugucaucauaagaaaggagaagcaagaagaucuagacgagcaguaacauuaccaucacauucaacuagaaaacuacaaacaagaagccaaacaugguuagagaguagagaauacaccaaacaucuaauaaggguugaaaauuggauauuucguaauccugguuucgcauuagcagcagcagcuauagcaugguuauuaggaagcaguacaucacaaaaaguaauauacuuagucaugauauuacuaaucgcaccagccuauucaauaagauguauaggaguuaguaauagagauuuuguggaagguaugagugguggaacauggguugacaucguacuagaacauggaggguguguuacuguaauggcacaagauaaaccgacaguugauaucgaauuagugacaacaacaguaucuaauauggcagaaguaagaagcuauuguuaugaagcuagcauauccgauauggcaucagacagcagaugucccacacagggagaagcauaucuugauaaacagucagacacacaguauguaugcaaaagaacauuaguagacagaggguggggaaacggaugugguuuauuuggaaaaggaucauuaguaaccugugcuaaauuugcaugcagcaagaaaaugacuggcaaaaguauacaaccggaaaaucuagaauaccgaauaaugcucaguguucacggaucacaacauucagguaugauuguaaacgauacuggacaugaaacagaugaaaacagagcaaaagucgaaauaacuccaaacaguccacgagcagaagcuacuuuaggcgguuuuggaucccuuggauuagauugugagccacgaacuggauuagauuucagugauuuauauuauuuaacaaugaauaauaaacacugguuaguacacaaagaaugguuccaugauauaccauuaccuuggcaugcaggagcugauacagggacaccacacuggaauaacaaagaagcccuaguagaauuuaaagaugcacaugcgaaacgacaaacaguuguugucuuaggaucucaagaaggugcaguacauacagcauuagcaggagcccuagaagcagaaauggacggugcuaaagggcgauuaucuagcggacauuuaaaauguagauuaaaaauggauaaauuaagacuaaaagguguuagcuauaguuuauguacagccgcauucacauucacuaaaauaccugcagagacucuacauggaacaguaacuguagaaguacaauaugcagguacugacggaccuugcaaaguuccagcacaaauggcaguugacaugcaaacacuaacuccaguaggaagauuaauaacggcgaacccaguuauaacagaaucaacugaaaauagcaaaaugaugcuugaacuagauccaccauuuggagacucauauauaguaauaggaguaggcgaaaagaaaauaacacaucacuggcauagaagugguagcacuauugguaaagcauuugaagcaacuguaagaggugcaaaaagaauggcaguauugggagauacugcaugggauuuuggaucaguaggcggggcacuaaauucacuugggaaaggaauacaucaaauauuuggagcagcauuuaaaucuuuauuuggaggcaugucaugguucucacaaauauugauuggaacccuacuuauguggcuagguuuaaacacuaaaaauggaucaauuucauugaugugcuuagcauugggaggaguauuaauauucuuaagcacagcaguaagugcagacguaggaugcaguguugacuuuaguaaa

SEQ ID NO: 2507 - RNA, 2127 nt, Artificial Sequence
  ZIKV prME variant CDS opt
agaggauuaaguagcagaaaaagaagaagccaugacguguuaacaguacaauuucugauacugggaaugcuacuaaugacuggagcaguaacuagaagaggaagcgcauauuauauguacuuagauagaaaugaugcuggugaagcuauauccuuuccaaccacauugggaaugaauaaauguuauauacaaauuauggacuuaggacauaugugugaugcuacaaugucauaugaguguccuaugcuagaugaaggaguagaaccagaugacguagauuguugguguaauacaacgucaacauggguaguauauggaacuugucaucauaagaaaggagaagcaagaagaucaaggagagcugugacacuaccuucacauagcacaagaaaacuucaaaccagaagccaaacauggcucgaaucaagagaauauacuaaacaucuaauacguguugaaaauuggauauuuagaaacccaggauucgcacuugccgcagcagcaauagcaugguuauuggguucgaguacaucucagaaaguaauauacuuaguaaugauucuauuaaucgcaccagcauauucaauaagaugcauaggagugagcaaccgagauuuuguugaaggcaugaguggaggaacguggguugauauaguucuggaacacggaggauguguuacaguaauggcacaagacaaaccaacaguagacauagaauuggucaccacaacaguaaguaauauggcagaaguaagaagcuacuguuacgaggccaguauuagugauauggcaucagauuccagauguccuacacaaggagaagcauauuuagacaaacaaucagauacacaauauguauguaaaaggacauuaguugacagaggauggggaaauggaugcggauuauuugguaaaggaucauuagugacaugugcuaaauuugcaugcaguaagaaaaugacaggaaaaagcauacaaccggaaaaucuugaguauaggauaauguuaaguguacacggaucacaacauucuggaaugauuguaaaugauacuggacaugaaacagaugaaaaucgagcaaaaguagaaauaacucccaauucaccaagagcugaggcaacacuaggaggauuugggagcuuaggauuagauugugaaccuaggacuggacuugauuuuagugaucuauauuauuuaacgaugaauaauaaacauuggcuaguacauaaagaaugguuucaugacaucccauuaccauggcaugccggggcagauacaggaacaccacacuggaauaacaaagaagcguugguagaauuuaaagaugcacaugcaaaaagacaaacaguuguaguauuaggaagccaagagggagcaguacauacugcacuugcaggagcauuagaagcagaaauggauggugcaaaaggaagacuaucaucagggcauuuaaaauguagacuuaaaauggauaaauuaagacuaaaaggcguaagcuauucauuauguacagcagcauuuacuuucacaaaaauaccagcagaaacauuacauggaacaguaacaguggaaguacaauaugcgggaacagauggaccauguaaaguuccagcacaaauggcaguugauaugcaaacauuaacaccaguuggaagacuaauaacagcaaauccaguaauaacugaauccacagaaaacucaaaaaugaugcuugaacuagauccaccauuuggagauaguuauauagugauuggcguuggggagaagaaaauaacacaucauuggcauagaucaggaucaacaauaggaaaagcauuugaagcaacuguaagaggagcaaaaagaauggcaguucuaggagauacagcaugggauuuuggaagcguuggaggagcgcuaaauagcuuggggaaagggauucaccaaauauuuggagcugcauuuaaaucauuauuuggaggaaugaguugguuuagccaaauacuaauaggaaccuuauugaugugguuaggauuaaauacuaaaaacggaaguauaaguuuaaugugucuagcacuagggggaguuuuaauauuuuuaaguacagcaguaucagccgauguaggcuguaguguagauuuuucaaaa

SEQ ID NO: 2508 - RNA, 2118 nt, Artificial Sequence
  ZIKV prME variant CDS opt
agaauuauaaaugcaaggaaagagaaaaaaagaagaggugcagauacaagcguugguauaguaggacuacuauuaacaacugcaauggcggcagaaguaacaagacgugguucagcuuauuacauguauuuagauagaaacgaugcuggagaggcaauaucauuuccuacaacuuuaggaaugaauaaaugcuauauacaaauaauggauuuaggacauaugugugacgcaacaaugaguuaugaaugcccuaugcuagaugaaggaguugaacccgacgauguagauuguuggugcaauacuacaaguacauggguuguauauggaacaugucaucacaaaaaaggagaggcuagaagaucaagaagagcaguaacauuaccuucacacagcacacgaaaacuacaaacaagaucacaaacaugguuagaaucaagagaauacacaaaacaucuaauuaggguagaaaauuggaucuuuagaaauccuggcuuugcacuugcagcagcagcaauagcuugguuauuagguagcaguacaucucaaaaaguaauauauuuaguaaugauacuacuaaucgcaccagcauacagcauaaggugcauaggaguaucuaauagggauuuuguagaaggaaugucaggaggaacauggguugacauuguacuagaacauggugguuguguaacaguaauggcgcaagauaaaccaacagucgauauagaacuaguaacaacaaccguaucaaauauggcugaaguuagaucauauuguuaugaagcaucaaucagcgauauggcaucagacagcagaugcccaacucaaggagaagcuuauuuagauaagcaaucagauacucaauacguauguaaaagaacacuagucgauagaggaugggguaacggaugugguuuauucggcaaaggaucauuaguuaccugugccaaauuugcauguucaaaaaaaaugacuggaaaaagcauacaacccgagaauuuagaauauaggauaauguugucuguccauggaucucaacacucagguaugauaguuaaugauacaggacacgaaacagaugaaaauagggcuaaaguagaaauaacacccaauaguccucgagcugaagcaacacucggaggauuuggaagucuaggacuagacugugaaccaagaacaggacuagacuuuagugaucuauauuauuuaacaaugaacaacaaacauuggcuaguacauaaagaaugguuucacgacauaccucuaccuuggcacgcaggcgcugauacaggaacaccacacuggaacaauaaagaagcacuaguugaauuuaaagaugcucacgcaaaaagacaaacagucgucguacuaggaagucaagaaggagcuguacauaccgcgcuagccggcgcuuuagaagccgagauggacggagcaaaaggaagauuaucaucgggacacuuaaaauguagauuaaaaauggacaagcuaagauuaaaaggagucucauauucacuaugcacagcagcauuuacauucacaaaaauuccugcggaaacacuacauggaacaguaacuguugaaguacaauaugcaggaacagauggacccugcaagguuccugcacaaauggcuguagauaugcaaacacuaacaccaguaggaagacuaauaacagcaaacccaguaauaacagaaucuacagaaaauucaaaaaugauguuggaauuagauccaccauuuggggauaguuauauaguaauagguguaggagaaaaaaaaauaacacaucacuggcauagaaguggcuccacgauaggaaaagcauucgaagcaacaguacgaggagcaaaaagaauggcaguacuaggagacacagcaugggauuucggauccguuggaggagcauugaauucauuagguaaagguauccaccaaauauuuggagcggcauuuaaaucguuauucggaggaaugaguugguuuucucaaauccuaauugguacacuacucaugugguuagguuuaaacacaaaaaaugguucaaucucauuaaugugcuuagcgcuuggaggaguacuaauauuucucaguacagcugugagugcugacguagguugu

SEQ ID NO: 2509 - RNA, 2115 nt, Artificial Sequence
  ZIKV prME variant CDS opt
auuauuaaugcaagaaaagaaaagaaaagaagaggugccgauacaagcguaggaauaguaggacuacuacuuacaacagcaauggcagccgaaguaacaagacgcgguucugcuuauuauauguaucuagacagaaaugaugcuggagaagccauuaguuucccaacaacauuaggaaugaauaaauguuacauacaaauaauggaccuaggacacaugugugacgcaacaaugucauaugaaugcccaauguuagacgaagguguugaaccagacgauguagauuguugguguaauacaacaucaacauggguuguuuauggaacaugccaucauaagaaaggcgaggcuagaagaucaagacgagcagucacauuaccuagucauaguacaagaaaauuacaaacaagaucucagacauggcuugaaucaagagaauauacaaaacacuuaauuagaguugaaaauuggaucuuuagaaacccugguuuugcacuagccgcagcugcaauagcuuggcuauuaggaucaucuacaucacaaaaaguaauauauuuagucaugauucuacuaauagcaccagcauauucaaucagaugcauaggagugagcaauagagauuuuguggaaggcaugucuggagggacauggguagauauuguauuagaacauggagggugcguaacuguuauggcacaggauaaaccaacaguagacauagaauuaguuacaacaacaguuucaaauauggcggaaguuagaaguuacuguuaugaagcaucaauuucagauauggcaucagauaguagauguccaacacaaggggaggcuuauuuagauaaacaaagugacacucaauauguauguaaacgaacauuaguagauagaggauggggcaacgguugugguuuauuuggcaaaggaaguuuaguaacaugugcaaaauuugcguguaguaagaaaaugacaggcaaaucaauacaaccagaaaacuuagaauaucgaaucaugcuuaguguacacggcucacaacauucaggaaugauuguaaaugacacuggacaugagacagaugaaaacagagcaaaaguggaaauuacaccuaacucaccaagagcagaagcuacguuaggagguuucggaucucuuggauuagacugugaaccaagaacaggcuuagacuucucugaucuauauuaucuuacaaugaauaacaaacauugguuaguacauaaagagugguuucaugauauaccauuaccauggcacgcaggagcagauacagggacgccacauuggaacaauaaagaagcucuaguagaauuuaaagaugcacacgcaaaaagacaaacaguaguuguuuuagguucucaagaaggagccguacacacagcacuagcuggagccuuagaagcagaaauggacggggcuaaagguagauuaucaucuggacacuuaaaauguagauuaaaaauggauaaauuaagauuaaaaggaguaaguuauagccuguguacagccgcauuuacuuuuaccaaaauaccagcagaaacauuacaugguacaguaaccguagaagugcaguaugcaggaacagaugggccuuguaaagucccagcucaaauggcaguagauaugcaaacacuuaccccaguaggcagacuuauaacugcaaauccagugauaacagaaucaaccgagaacuccaaaaugaugcuagaacuagauccaccauucggagauaguuauauaguuaucggagucggagaaaagaaaauaacucaucauuggcauagaucagguagcacgauaggaaaagcauuugaagcaacagucagaggugccaaaagaauggcaguauugggagauacagcaugggacuuuggaagugucggaggagcacuaaauagcuuaggaaaaggaauacaucaaauuuucggagcagcauuuaaaucuuuauuuggaggaaugagcugguucucacaaauacuuauaggaacauugcugaugugguuaggacucaauaccaaaaacggaagcauaucauuaaugugucuagcacugggaggugucuuaauauuccuaucgacagcaguaucagcagaugugggaugu

SEQ ID NO: 2510 - RNA, 2112 nt, Artificial Sequence
  ZIKV prME variant CDS opt
aucaacgcaagaaaagaaaaaaaaagacgaggagcagacacaaguguaggaauaguaggauuacuuuugacaacugcaauggcagcggaaguaacaagaagaggaagugcauauuauauguauuuagaccgcaaugaugccggugaagcgauaucauucccaacuacuuuaggaaugaauaaauguuauauacaaauaauggauuuaggacauaugugugaugcaacgaugagcuaugaaugccccauguuagaugaaggaguagaaccagacgauguagacuguugguguaauacaacaaguacauggguaguauauggaacgugucaucacaaaaaaggagaagcaaggagaaguaggagagcaguaaccuuaccaucccauagcacucgaaaauuacaaacaagaagccaaacaugguuagaaagucgagaauauacaaaacauuuaauaagagucgaaaauuggauauuuagaaauccaggauucgcauuagcagcagcugcaauagcauggcuauuagguucaucaacaagucaaaaaguaauauauuuaguaaugauuuuacuaauagcaccagcauauucaauaagauguauuggaguaagcaaccgcgauuuuguagaaggaaugucaggaggaacauggguagacauaguacuagaacauggagggugugucacaguaauggcacaagauaaaccaacgguagauauagaauuaguaacgaccaccguuucuaacauggcugaaguacgaucauauugcuacgaagcaucaauaagcgacauggcaucagauucuagauguccaacucaaggagaagcguauuuggauaaacaauccgauacacaauacguaugcaagaggacucuaguagauagggguuggggaaacggauguggguuauuuggaaaaggaaguuuaguuacaugugcuaaguuugcguguaguaaaaaaaugacaggaaagucaauucaaccagaaaauuuggaauacagaauaauguuaagcguacauggcucacaacacagcggaaugauagugaaugacacaggacaugaaacagaugaaaauagagcaaaaguagaaauaacaccaaauaguccaagagcagaagcgacacuaggagguuuugguucauuaggucuagauugcgaaccucgaacagguuuagacuuuucagaucuguauuauuuaacaaugaacaauaaacauugguuaguccauaaagaaugguuucacgauauaccuuuaccguggcacgccggagcagacacaggaacaccccauuggaauaauaaagaagcacuaguagaguuuaaagacgcucaugcaaaaagacaaacuguaguaguuuuggguagccaagaaggagccguacauacagcauuagcaggagcgcuagaagcagagauggacggcgcuaaaggaagauuauccuccggacauuuaaaaugucgauuaaaaauggauaaauuaagacuaaaaggaguaucauauaguuuaugcaccgcagcuuuuacauuuacaaaaauaccugcagaaacucuacauggaaccguaacaguagaaguucaauaugcaggcacagauggaccauguaaaguuccugcacaaauggcuguagauaugcaaacacucacacccguuggaagauuaauaacagcgaacccaguaauaacugaaagcacagaaaauaguaaaaugauguuagaauuagacccaccauucggagauaguuauauaguaauagguguaggagaaaaaaaaauaacucaccauuggcacagaucagggucaacuauuggaaaagcauuugaggcaacaguaagaggagcgaaacguauggcaguauuaggagacaccgcgugggacuuugguagcguaggaggagcauuaaacucguuaggaaaaggaauccaucagauauucggagcagccuuuaaaagucucuucggaggaaugagcugguucucacaaauuuuaauaggaacauuacuaauguggcuaggauuaaauacaaaaaauggcaguauaucauuaaugugcuuagcucuaggaggaguacuaauauucuuaaguacugcagucucagcugaugugggaugc

SEQ ID NO: 2511 - RNA, 2109 nt, Artificial Sequence
  ZIKV prME variant CDS opt
aacgcaagaaaagaaaaaaaacgucguggugccgauacaaguguaggaauaguaggauuauuguuaacaacagcaauggcagcagaaguaacacgaagaggaucagcauauuacauguauuuggauagaaaugaugcgggagaagcaauaucauuuccaacuacacuuggaaugaauaaauguuauauucaaauuauggauuuaggacauaugugcgacgcuacaaugucauacgaaugcccgauguuagacgaagggguggaaccagaugacgucgauuguugguguaauacaacgucaacguggguaguauauggaacaugccaucacaaaaaaggcgaagcuagaagaagucguagagcaguaacauuaccaagccauaguacaagaaaauuacaaacacgaucccaaacuugguuagaaucaagggaauacacuaaacauuugauaagaguagaaaauuggauauuuagaaauccggguuucgcccuugcggcagcagcaauagcaugguuacuaggaucuucaacaagucaaaaaguaauauauuuaguaaugauacuuuuaauagcaccagcuuauagcauaagaugcauugguguaaguaauagggacuuuguagaagguaugucagguggaacauggguagauauaguacuagaacauggagguugcguaacaguuauggcacaagauaaaccaacggucgacauagaacuaguuacaacaacaguuagcaauauggcagaaguaagaucauauuguuacgaagcaucuauaagcgacauggcaagugauucuagauguccaacacaaggagaggcauaccuugauaaacaaagugauacucaauauguaugcaaaagaacauuaguagaucgaggauggggaaacggguguggucuauuugguaaaggaucauuaguaacgugugcaaaauuugcauguucgaaaaaaaugacaggaaaaucaauacaaccagaaaacuuagaauauagaauaaugcucagcguacaugguucacaacauucaggaaugauuguaaaugauacaggucaugaaacagaugaaaaccgagcaaaaguagaaauuacuccaaauaguccaagagcugaagcaacacuuggagguuuuggaagucuaggacuagacugcgaaccaagaacuggauuagauuuuucugaucuauacuaucuaacaaugaacaauaagcauugguuaguacauaaagagugguuucaugauauuccacuaccuuggcaugcaggugcugauacaggaaccccacauuggaauaauaaagaagcuuugguagaauuuaaagaugcacaugcaaaaagacaaacuguaguaguauuaggaucacaagaaggagcaguacacaccgcacuagcaggagcuuuagaagcugaaauggauggagccaaaggaagauuauccaguggacauuuaaaaugcagauuaaagauggacaaacuacgacuaaaaggaguaagcuauucauuauguacagcagcauuuacauuuaccaaaauaccugcugaaacucuacacggaacaguaacaguagaaguacaauaugcggguacagauggaccauguaaaguaccagcucaaauggcuguagauaugcagacuuuaacaccgguaggaagauugauaacugcaaauccuguaauaacugaaucaacagaaaauaguaaaaugauguuagaauuagauccaccauucggagauucauacauaguaauuggugucggggaaaaaaaaauaacccaucauuggcauagaucaggaaguacaauaggaaaagcuuuugaagcaacaguaagaggagcaaaaagaauggcggugcucggagauacagcuugggauuuuggcaguguagguggugcacuaaauucauuagguaaaggaauacaucaaauuuuuggagcugcguuuaaaucacuauucggaggaaugucuugguuuucucaaauauuaauugggacuuuguuaaugugguuaggucuaaauacaaaaaaugggucaauaucacuaauguguuuagcacugggaggaguauuaauuuuuuuaaguacagcaguaagcgcagacguaggaugu

SEQ ID NO: 2512 - RNA, 2106 nt, Artificial Sequence
  ZIKV prME variant CDS opt
gccagaaaagaaaaaaaaagaagaggagcugauacaucaguaggaauaguaggacuauuguugacaacagcaauggcagcagagguaacaagacgagguagcgcauauuacauguauuuagauagaaacgaugcaggagaagcuauaucauucccaacuacauuaggaaugaacaaaugcuauauacaaauuauggauuuaggacauaugugugaugcaacaaugaguuaugaaugcccuauguuagaugaaggaguagaacccgacgauguugacugcuggugcaauacgacaaguacauggguuguauaugguacaugucaucauaaaaaaggagaagcaagacgaaguagacgcgcagucacauuaccgagccauagcacgcguaaacuacaaacacgaucacaaacuuggcuagagaguagagaauauacuaaacauuuaaucagagucgaaaacuggauauucaggaaucccggauuugcauuagcagcagcagcaaucgcauggcuauuaggcucaaguacuagucaaaaaguaauauauuuaguaaugauauuacuaauugccccagcauacaguauaagauguauagguguaagcaaccgagacuucguagaaggaaugucuggaggaacauggguugacauuguacuagaacacggagguugugucacagugauggcgcaagauaaaccuacaguugauauugaacuaguuacaacaacaguaaguaacauggcugaaguaagaucauacuguuaugaagcaucuauaagugauauggcuagugacagucgauguccaacacaaggcgaagcauacuuagauaaacaaucagauacucaauauguauguaaaagaacacuagucgacagaggguggggaaacggauguggacuauuuggaaaaggaucgcuagugacaugugcaaaauuugcaugcucaaaaaaaaugacaggcaaaucaauacaaccugaaaauuuagaauaccggaucauguuaucaguccaugguucacaacauagcggaaugauagucaaugauacaggacaugaaacggaugaaaacagggcaaaaguagaaauaacuccaaacaguccaagagcagaagccacauugggaggcuuuggaagcuuaggauuagacugcgaaccgcguacaggcuuagauuucuccgaucuuuauuaucuaacuaugaauaauaaacauugguugguacauaaagaaugguuucacgacaucccauuaccuuggcaugcaggagcagauacaggaacaccacauuggaacaauaaggaagcauuaguagaauucaaagacgcacaugcaaaaagacaaacaguaguaguacuaggaucacaagaaggagcaguccauacugcucucgcaggagcguuagaagcagaaauggacggagcaaaagggcguuugagcucaggacauuuaaaaugcagauuaaaaauggauaaauuacgauuaaaaggaguaucuuacucgcuauguaccgcagcuuucacauucacaaaaauaccagcagaaaccuuacaugggacaguaacgguugaagugcaauaugcagggacagauggcccauguaaaguacccgcucaaauggcaguugacaugcaaacucuaacaccaguaggaagauuaauuacagcaaacccaguaauuacagaaaguacugaaaacaguaaaaugauguuggaacuagauccaccauuuggagacagcuauauaguuaucggcguaggugaaaaaaaaauaacacaucauuggcauagaagugguaguacgauaggaaaagcuuucgaagcuacgguaagaggagcaaaaagaauggcagucuugggagauaccgcaugggauuuugguaguguugguggugcauuaaauucauuagguaaaggaauacaccaaauauuuggagcagcauucaaaucuuuauucggagguaugaguugguuuucacaaauauugauaggaacauuacuaauguggcuaggcuuaaauacaaaaaaugguuccauaaguuuaauguguuuagcauuaggggguguguuaauauuuuuaucuacugcaguuagugcugauguaggcugu

SEQ ID NO: 2513 - RNA, 2103 nt, Artificial Sequence
  ZIKV prME variant CDS opt
agaaaagaaaagaaaagaagaggugcagacacuucaguaggaauugugggauugcuacuuacaacugcaauggcagcagaaguaacacgacguggaucugcauacuauauguacuuagacaggaaugacgcuggugaagcaauaaguuuuccaacaacauuaggcaugaacaaaugcuacauacaaauaauggaccuaggacauaugugugacgcaaccaugaguuacgaauguccaauguuagaugaaggaguagagcccgaugauguagauugcugguguaauacaacaagcacauggguaguguauggaacaugucaccauaagaaaggugaagcaagaagaucaaggagagcaguaacucuuccaucacauucaacgcgaaaauuacaaacaaggucacaaacaugguuagaaaguagagaauauacgaaacaccucauaagaguagaaaauuggauauucagaaaucccggcuuugcacuagcagcagcagcaauagcaugguuacugggaaguaguacaucacagaaaguaauauauuugguaaugauauuacuuauagccccagcauauucaauuagauguauaggaguuucgaauagagauuucguggaaggcaugaguggaggaacguggguagacauaguuuuagaacauggaggaugugucacagugauggcacaagauaaaccgacaguagauauagaauuagugacaacuacaguaaguaauauggcagaaguuagaaguuauuguuaugaagcauccauaagcgauauggcuucagauucaagauguccgacucaaggagaagcauauuuagauaaacaaagugacacacaauacguauguaaaaggacucuaguagauagaggaugggguaauggauguggguuauuugguaaaggaucuuuagucacaugugcaaaauucgcaugcaguaagaaaaugacaggcaaaaguauccagccagaaaauuuggaauauaggauaaugcuaucaguacacgguucucaacauuccggaaugauugucaaugauacaggucaugaaacagaugaaaacagggcgaaaguggagauuacaccaaacucaccaagagcggaagcaacacuagguggauuugguucauugggauuagauugcgaaccaagaacaggauuagauuuuucagaucuguacuauuuaacuaugaacaacaaacauugguuaguacauaaagaaugguuucaugauauaccauuaccauggcaugcgggagcagauacaggaacgccacacuggaacaacaaagaagcacucguagaauuuaaagacgcacaugcgaaacgacaaacaguaguaguauuaggaagccaggaaggagcaguacauacagcacuagcaggcgcauuagaagcagaaauggauggagcaaaagguagauuaaguaguggacauuuaaaauguagguuaaaaauggauaaacuaagauuaaaaggaguaaguuauaguuuaugcacugccgcauucacauuuaccaaaauaccugcagagacauuacauggcacaguaacaguugaaguacaauacgcaggcacagaugggccaugcaaagugcccgcucaaauggcaguagauaugcaaaccuuaacgccaguuggcagauuaauaacugcaaacccaguuauaacugaaucgacagaaaacagcaaaaugauguuagaacuagauccgccuuuuggagauucauauauaguaauuggaguaggagaaaagaaaauaacacaucacuggcauagaaguggaagcacaauaggaaaagcauuugaagcgacaguaaggggagcgaaaagaauggccguauuaggagauacagcaugggacuucgguaguguaggaggagcuuuaaauagucuaggaaaaggaauacaucaaauauuuggagcagcuuuuaaaucacuauuuggugguaugucaugguuuucacaaauauuaauaggaacauuacuaauguggcuaggccuaaauaccaaaaauggaaguauaaguuuaauguguuuagcauuaggugguguauuaauauuucuaaguaccgcaguaucagcagauguuggaugu

SEQ ID NO: 2514 - RNA, 2100 nt, Artificial Sequence
  ZIKV prME variant CDS opt
aaagaaaagaaaagaagaggugcagauacauccguaggcauaguagguuuguuauuaacaacagcaauggcugccgaagugacuagacguggaagugcauacuacauguauuuagauagaaaugaugcuggagaagcuauuucauuuccuaccacauuaggaaugaauaaauguuacauacaaauaauggaucuaggucacaugugcgaugccacaaugagcuacgaauguccaauguuagaugagggaguagaaccagacgauguugauuguugguguaauacaacaucaacguggguaguuuaugguacaugccaucauaagaaaggagaagcuagaagaucaagacgagcaguaacauuaccaagucacucaacuagaaaacuacaaacaagaagccaaacauggcuagaaagcagagaauauacuaaacaccuuauuagaguagaaaauuggauauuuaggaacccaggauuugcuuuagcggcugcugcaauugcauggcugcuuggaucaaguacaucucagaaagucauauaucugguaaugaucuuauuaauagccccugcauacaguaucaggugcauaggaguaucgaaucgugauuucguagaaggaaugagcgggggaacauggguugacauaguauuagagcauggaggauguguuacaguaauggcacaagauaaaccaacugucgauauagaauuaguaaccaccacaguaagcaacauggcagaaguaagaaguuauuguuaugaagcaucaauaagcgauauggcaucugacucacgauguccaacacaaggggaagcauaucucgauaaacagucagauacucaauauguuuguaaaagaacucuaguagaucgaggcuggggaaacggaugcggucucuucggaaaaggaucauuaguaacaugugcaaaguucgcauguaguaagaaaaugacaggaaaauccauacaaccagaaaauuuagaauauagaauuauguuaagcguacaugguucucaacacucaggaaugauaguaaaugauacaggccaugaaacagacgaaaacagagccaaaguagagauaacaccaaacaguccacgagcugaagcuacauuaggaggguucggaucauuaggacuggauugugaacccagaacuggucuagacuuuucagaccuuuacuauuuaacaaugaauaauaaacauuggcuaguacacaaagaaugguuucacgacauuccguuaccauggcaugcgggugcagauacaggcacaccacauuggaauaauaaagaagcucuaguagaguuuaaagaugcacaugcaaaacgacaaacagucguaguacuagguagucaagaaggagcaguacauacugcauuagcuggagcauuagaagcagaaauggauggagcaaaaggaaggcuaucauccggucaucuaaaauguagacuaaaaauggauaaacugagauuaaagggagucagcuauucauuauguacagcagcauucacauucaccaaaaucccagcagagacuuuacauggaacaguaacagucgaaguacaauaugcagguacagauggaccauguaaaguuccagcacaaauggcuguagauaugcaaacguuaacacccguugguagacuaauaacagcuaacccaguuauuacagaaagcacagaaaauucaaaaaugauguuagagcuagacccaccauucggugauagcuauauugucauaggagucggagaaaagaaaauaacacaccauuggcacagaucaggaucaacaauaggaaaagccuuugaagcuacaguaagaggagcaaaacgaauggccguauuaggugauacagcaugggauuuuggaucaguuggaggagcacuuaacucucuagguaaaggaauacaucaaauauuuggagcagcuuucaaaucucuauuuggugguaugaguugguuuagucaaauauuaauugguacauuacuaaugugguuaggucuaaauacuaaaaaugguucaauaaguuuaauguguuuagcauuaggaggcguuuuaauauuuuuaaguacagcaguaagcgcugacguuggcugu

SEQ ID NO: 2515 - RNA, 2097 nt, Artificial Sequence
  ZIKV prME variant CDS opt
gaaaagaaaagaagaggagcagauacaaguguaggaauuguuggacuauuauuaacuacagccauggcagcagaaguaacgagaagggguagugcuuauuacauguaucuagacaggaaugaugcaggggaagcaauaucuuucccaacuacauuaggcaugaauaaauguuauauucaaauaauggaucuaggacauaugugugaugcaacaaugucauaugaaugcccaauguuagaugaggguguggaacccgaugauguagauugcugguguaauacaacaagcacauggguuguauauggaaccugccaucauaagaaaggagaagcaagaagaucuaggagagcagugacguuaccaagucauuccacaagaaaauuacaaacaagaucgcagacaugguuagaaagcagagaauacacaaaacacuuaauaagaguagaaaauuggauuuucagaaauccagguuuugcauuagcagccgcagcaauagcauggcuccuaggaucaaguacaucucaaaaaguuauauauuuagucaugauacuacuaauugcuccugcauauaguauaagaugcauagguguuaguaauagagauuuuguagaagggaugucaggagguacauggguagauauaguauuagaacauggaggauguguaacuguaauggcacaagacaaaccuacaguagauauagaacucguaacuacaaccguaaguaauauggcagagguaagaucauauuguuacgaagcaucaauaucagauauggcaucagauaguagaugcccuacgcaaggagaagcauaucuagauaaacaaagcgauacucaauauguauguaaacgaacuuuaguagauagaggguggggaaauggauguggacuauuugguaaaggaucuuuaguaacuugugcaaaauuugcuuguucaaagaaaaugacuggaaaaucaauucaaccagaaaauuuagaauaucgaauaauguuaucaguacauggaucgcaacacagcggaaugauaguaaacgauaccggacacgaaacugacgaaaacagagcaaaaguagagauaacacccaauaguccaagagcagaagcuacacuaggaggauuuggcagccuuggacucgacugugagccaagaacgggauuagacuuuagcgaucuauauuacuuaacaaugaauaacaaacauugguuaguccauaaagaaugguuucaugacauuccacuaccauggcacgcuggugcagauacuggaacaccgcacuggaauaauaaagaagcccuaguugaauuuaaagaugcacaugcaaaaagacaaacagucguaguauuagguucucaggaaggagcaguucauacagcauuagccggugcauuagaagcagaaauggauggagcaaaaggaagauuaaguucuggacaucugaaaugucgacuaaaaauggacaaacuaagauuaaaaggaguaucauacucauuauguacagcagcauuuacauucacuaaaauaccagcagaaacauugcacgguacaguaacaguagaagugcaauaugcuggaacugauggcccguguaaaguaccggcacaaauggcuguagauaugcagacauuaacaccaguaggaagauuaauaacagcaaauccuguaauaacagaaagcacagaaaacaguaagaugauguuagaauuagacccacccuucggggacagcuauauaguuauaggaguuggagaaaagaaaauaacacaucacuggcauaggucaggaucaacaauagggaaagcauucgaagcgacuguuagaggagcaaaaagaauggcgguauugggagauacugcaugggauuucggaucaguaggaggagcauugaauagucuaggcaaagguauacaccaaauauucggggcagcauuuaaauccuuauuugguggaaugaguugguuuagucaaauuuuaauaggaacuuuacugaugugguuaggacuaaauacuaaaaauggauccaucucauuaaugugucucgcgcuaggaggaguacuaauuuucuuaucuacagcaguaucagcggacguaggaugc

SEQ ID NO: 2516 - RNA, 2094 nt, Artificial Sequence
  ZIKV prME variant CDS opt
aaaaaaagaaggggagcugauacaagcgucggaauaguaggacuauuauuaacaacagcaauggcagcagaaguaacacgaagaggcagcgcuuauuauauguauuuagauagaaaugaugcaggugaagccauaucauuuccaacaacucuaggaaugaauaaauguuacauacaaauaauggauuuaggacauaugugugaugcaacaaugaguuaugaaugcccaaugcuggaugaagguguugaaccugaugauguagauuguugguguaauacaacaucaacauggguaguauacggaacaugccaucacaagaaaggagaagcaagaagaucaagaagagcaguaacacuaccaagucacucuacaagaaaauuacaaacaagaagucaaacgugguuagaaucaagagaauauacaaaacacuugauacgaguagaaaacuggaucuuuagaaauccaggauucgcccuugcagccgcugcaauugcaugguuacuagguaguaguacuagucaaaaaguuauauaccuugucaugauauuauuaauagcuccagcauacucaauaagaugcauaggcguaaguaauagagauuuugucgaaggaauguccggaggaacauggguugacauaguauuagaacacggaggauguguaacaguaauggcacaagauaaaccaacuguugauauugaguuaguuacaacuacaguaucaaauauggcagagguacgaaguuauuguuacgaggcaaguauaucugauauggcaucugauucuagauguccaacucaaggagaagcauaucuugacaaacaaucugauacacaauaugucuguaaaagaacauuaguagaucguggaugggggaacggauguggauuauucggaaaaggaucacuaguaaccugugcuaaauuugcauguuccaaaaaaaugacugguaaaucaauccaaccagaaaauuuagaauacaggauaauguuaucaguccacgguagucaacauagcgguaugauaguuaaugauacaggacaugaaacagaugaaaaucgagcaaaaguugaaauaaccccaaauucaccaagagcagaagccacacuagggggcuuuggaucauugggauuagacugcgaaccucgaacaggauuggacuucucugauuuauauuaucuaacgaugaacaauaaacacugguuaguacacaaagaaugguuucacgauauaccucuaccauggcaugcaggugcagacacaggaacaccacauuggaacaauaaagaggcacuaguagaauucaaagaugcgcacgccaaacgacaaacagucguaguuuuagguucacaagaaggagcuguacauacagcuuuagcaggggcguuagaagcagaaauggauggugcgaaaggacguuugucaucuggucauuuaaaaugucgauugaaaauggauaaacuacgacuaaaaggaguaagcuacucacuuuguacugcggcuuuuacauuuacaaaaauaccagcagaaacccugcauggaacuguuacuguagaaguacaauaugcuggcacagacggaccuuguaaaguuccagcccaaauggcaguagauaugcaaacacuaacuccaguaggaagacuuauaacagcaaauccagugauuacagaaucaacagaaaauaguaaaaugauguuagaacucgauccaccauuuggagauagcuacauagucauaggaguaggcgaaaaaaaaauaacacaccauuggcauagaagcggaaguaccauaggaaaggccuuugaagcgacaguaagaggagcuaaacgaauggcaguacuaggggauacggcaugggacuuugguagcguaggaggagcauuaaacucucucggaaaaggaauacaccaaaucuuuggagcugcauuuaaaucauuauuugguggcaugaguugguuuagccaaauccuaauaggaacauuauuaaugugguuagguuuaaacacaaaaaauggauccauuucauugaugugucuggcacuuggaggaguauuaaucuuucuuuccacugcaguaagcgcagauguaggaugu

SEQ ID NO: 2517 - RNA, 2091 nt, Artificial Sequence
  ZIKV prME variant CDS opt
aagcgaagaggagcagauacuucaguaggaauaguaggacuauuauuaacaacagcaauggccgcagaagucacaagaagaggaucagcauacuauauguaccuagauagaaacgaugcuggagaagcaauaucguucccaacaacacuaggaaugaauaaauguuauauucagauaauggaucucggacauaugugcgaugcaacaaugucauaugaauguccaauguuagaugaaggagucgaaccugaugauguagauuguugguguaauacaacaucaacauggguaguauauggaacaugucaucacaaaaagggcgaggcuagaagaucccguagagccgucacauuaccaucgcauaguacaagaaagcuacaaacacguucucagacauggcuagaaaguagagaauauacaaaacauuuaauccgagucgaaaacuggauauuccgcaauccaggguuugcacuagcugccgcagcuauugcauggcugcuagguucaucaacgucacaaaaaguuauauaccuagugaugauauuauuaaucgcaccagcauauaguauuagauguauagguguaaguaauagagacuuuguagaagguaugagcggaggaacaugggucgauauaguauuagaacauggcggaugugugaccguaauggcacaagauaaacccacgguagauauagaauuggucacaacuacuguaucaaauauggcagaaguaagaucauacugcuacgaagcaucaaucucagauauggccucagauuccagauguccgacccaaggagaagcauaucuagacaaacaaucggauacacaauauguauguaaacgaacgcuaguugauagaggauggggaaauggauguggauuauuuggaaaaggaaguuuagucacaugugcaaaauucgcaugcagcaagaaaaugaccggaaaauccauacaaccagaaaaucuagaauauagaauaaugcuaucaguacacggaagccagcauaguggaaugauuguaaaugauaccggacaugaaacugacgaaaauagagcaaaaguagaaauaacaccaaauaguccaagagcagaagcaacauuagggggauucggaucacuagguuuagacugcgaaccacgaaccggauuagauuucagugacuuauacuauuuaacaaugaauaauaaacauugguuaguacacaaagaaugguuucaugacauaccauuaccauggcaugcaggagcagacacaggaacaccacacuggaacaauaaagaagcauuaguagaauuuaaagaugcacaugcaaaacggcaaacaguaguaguauuaggaagucaagaaggcgcuguacacacagcacuagcuggagcauuggaagcagaaauggacggagcaaaaggaagguuaucaaguggacacuuaaaauguagauuaaagauggauaaacuaagacuaaaaggaguaaguuauucauuaugcacagcugcuuuuacauuuacuaaaaucccagcagaaacacugcacgggacaguaacaguugaaguacaauaugcagguacugauggaccauguaaaguaccugcucaaauggcaguugauaugcaaacauuaacaccaguagggagauuaauuacugcaaacccaguaauaacagaaucuacugaaaauucaaaaaugauguuagaauuagauccaccguuuggagauaguuauauaguaauaggaguuggagagaaaaagauaacacaucauuggcacagaagcggaucaacuauaggaaaagcauuugaagccacaguaagaggagcaaaaagaauggcaguguuaggagauacagcaugggauuuuggaucagugggaggugcacuuaauucauuaggaaaagguauucaccaaauauucggagcagccuuuaaaagucuuuucggggguaugaguugguucagccaaauacuaauaggaacacuacuuaugugguuaggauuaaauacuaaaaaugguaguauaucuuuaauguguuuagcauuaggcggaguacugauauuuuuaucaacagcgguuagcgcugacguggguugc

SEQ ID NO: 2518 - RNA, 2088 nt, Artificial Sequence
  ZIKV prME variant CDS opt
aggcguggcgcagauacaucaguagggauuguaggauuauuauuaacaacagcaauggcagcagaaguuacaagaagaggaagugcauacuacauguauuuagauagaaacgaugccggagaagcaauauccuuuccaacaacauuaggaaugaauaaauguuauauacaaauaauggacuuaggacacaugugugacgcaacuaugucauaugaaugcccaaugcuagaugaaggagucgaaccugaugacguagauugcugguguaauacaacaaguacauggguaguauauggaacaugucaucauaagaaaggcgaagcaagacgaucaaggagagcaguuacacugcccucacacucaacaagaaaacuacaaacaagaucacaaacuugguuagaaucuagagaauauacaaaacaucuuauaagagucgaaaauuggauauuuagaaacccaggauuugcauuagccgcagcagcaauagcaugguuauuagggaguucaacaucacagaaaguuauauauuuaguaaugauauuauuaauugcaccagcauacucaauaagauguauaggaguuucgaauagggauuucguagaaggaaugucgggagguaccuggguagauauaguuuuagaacauggcgguuguguaacaguuauggcacaagauaaaccuacaguagauauagaacuuguaacaacaacaguuagcaacauggcugaaguaagaagcuauuguuacgaagcaucaauaucagacauggcauccgauucaagaugcccgacacaaggagaagcauaucuagauaaacaaucagauacacaauauguaugcaaacgaacucuaguagacagaggcuggggaaacgguugcggacuauucggaaaagguagccuaguaaccugugcuaaauucgcauguucaaagaaaaugacuggaaaaucaauucaaccugaaaacuuagaauauagaauuauguuaagcgugcauggaagccaacauucagguaugauugucaaugauacgggacaugaaacagaugaaaaccgugcaaaaguagaaauaacaccaaauuccccgagggcagaagcaacacuagggggauuuggaucacuaggcuuagauugugaaccuagaacuggauuagauuuuagugaucuauauuaccuaacaaugaacaauaaacauugguuaguucauaaagaaugguuucaugauauuccauuaccguggcacgccggugcagauacagguacgccacacuggaauaacaaagaagcauuaguagaauuuaaagaugcacaugcuaaacgucaaacugucguaguauuagguucacaagaaggagcaguacauacagcauuagcaggagcccuagaagcggaaauggauggagcaaaaggacgccuaucaaguggacacuuaaaaugucgcuuaaaaauggacaagcuaagauuaaaaggagucaguuauucucuaugcacagccgcuuucacauucacgaaaaucccugcggaaacacuucacggaacaguaacuguagaaguucaauacgcagguacagacggcccguguaaaguaccagcccaaauggccguagauaugcaaacauuaacaccaguaggaagacuaauaacugcaaauccaguuauaacagaaucgacagaaaacagcaaaaugauguuagaacuagacccaccauuuggagauucuuacaucguuaucggaguaggagaaaagaaaauuacacaccacuggcauagaaguggaucaacaauuggaaaagcauucgaagcaacgguaagaggagccaaacgaauggcaguuuuaggagacacugcaugggacuucggaagcguaggaggugcauuaaacucguuagggaaaggcauucaucagauauuuggagcagcauucaaaucauuauucggagguaugucaugguuuagucaaauacuaauuggaacuuuacuaaugugguuggguuuaaacacuaaaaacgguaguauaucacuuauguguuuagccuuaggcggaguguuaauauuuuuaucaacagcaguaagcgcugauguagguugu

SEQ ID NO: 2519 - RNA, 2085 nt, Artificial Sequence
  ZIKV prME variant CDS opt
agaggagcugauacaucaguaggaauuguagguuuauuacuaacaacagcaauggcagcagaaguuacaagaagaggaucagccuauuauauguauuuagaucgaaacgaugccggagaagcaauaaguuuuccaacaacuuuaggaaugaauaaaugcuauauacaaaucauggaucuuggacacaugugugacgcaacaauguccuacgaauguccaauguuagacgaaggaguagaaccugacgacgucgauuguugguguaauaccacaucaacauggguaguuuacgguacaugccaucauaagaaaggagaagcaaggcgaucaaggagagcaguaacauuacccucacauaguacaagaaaauuacagacuagaucacaaacauggcuugaaucgagagaauacacuaaacaccuaauaagaguagaaaacuggauuuuuagaaauccaggauuugccuuagcagcagcagcgauagcauggcuacuugggucuaguacaagucaaaaaguaauuuacuuaguaaugaucuuacuaauugcaccagcauacucaauaagaugcauuggaguaucaaauagagacuuugucgaagguaugagcgguggaacuuggguagacauugucuuggagcacgguggaugcguaacuguaauggcacaagacaaaccaacaguggacauagaauugguaacaacaaccguaaguaauauggcagaaguuagauccuauugcuacgaggcaucaauaagugacauggcaagugauucaagauguccaacacaaggagaggcuuaucucgauaaacaaagugauacccaauauguauguaaaagaacauuaguugacagagguuggggaaauggcuguggacuauucgguaaagggagcuuaguaacaugugcaaaauuugcauguucaaagaaaaugacaggaaaaucuauacaaccagaaaaucuagaauauaggauuauguuaagcguucauggaucgcaacauaguggaaugauugucaaugacacaggacaugaaacugacgaaaaccgagcuaaaguggaaauaacaccaaauucaccacgagcagaagcuacacucggaggcuucggaucacuaggauuggacugugaaccaagaacagguuuagauuucagcgaucuauauuauuuaacuaugaauaauaaacauugguuagugcauaaagaaugguuucaugauauaccauuaccuuggcacgcaggagcagauacaggcacaccacacuggaauaauaaagaagcccuaguagaauuuaaagaugcacacgcuaaaagacaaacaguaguuguacuaggaucacaagaaggugcuguacauacagcacuugccggggcauuagaagcagaaauggauggagcuaaaggaagauuaagcucaggucacuuaaaauguagauuaaaaauggauaaauuaaggcuaaaaggaguaagcuacucuuuauguaccgcagcuuucacauuuacaaaaauaccagcagaaacauuacauggaacaguaacuguagaaguacaauaugcagguacagaugguccauguaaaguaccagcacagauggcaguagauaugcaaacauuaacaccaguagggagauugauaacagcuaauccugucauaacagaaucaacugaaaauagcaaaaugaugcuagaacuagauccaccauucggugauucauauauaguaauaggaguuggagaaaagaaaauaacgcaucacuggcauagaagcgguaguacaauaggaaaagcauuugaggcaacaguaaggggcgcaaaaagaauggcuguauuaggagauacagcaugggauuucggaagcgucgguggagcacuaaauucacuaggaaaagguauucaucaaauauucggagcagcuuuuaaaucuuuguuuggaggaaugaguugguuuucucaaauacuaauuggaacauugcugaugugguuaggacuaaacacuaaaaacggaucaauuagcuuaaugugucuagcucucggagguguauugauauuuuuaucaacagcuguaucagcggacguuggaugc

SEQ ID NO: 2520 - RNA, 2082 nt, Artificial Sequence
  ZIKV prME variant CDS opt
ggagcugauacaagugucggaauagucggacuauuacuaacuacagcuauggcagcggaaguuaccagaagaggcagcgcauauuauauguauuuagauagaaaugaugcaggagaagcaauauccuuuccuaccacucuaggaaugaauaaauguuauauacaaauaauggaccuaggacacaugugcgaugccacuaugaguuacgaaugcccuaugcuugaugaaggagucgaaccugaugauguagauugcugguguaauacaacaaguacauggguaguauacggaacaugccaucauaagaaaggagaggccagaagaucaaggagagcaguaacacuacccucucauucaacaagaaaauuacaaacaagaagccaaacaugguuggaaaguagagaauauacaaaacaucuaauucgaguagaaaauuggauauuuaggaacccaggauuugcacuagcagcagcagcaauugcuugguuacuaggaucaucaacaucacaaaaaguaauauaccuaguaaugauacuauuaauagcaccagcauauaguauaagauguauaggaguaucuaaccgagauuuuguugaaggaaugagcgggggaacauggguagauauaguguuagaacauggaggauguguuaccguaauggcacaagauaaacccacaguggacauagagcuaguuacaacuaccgucucaaauauggcagagguacgaagcuauugcuaugaagcgagcauaagugauauggcaagugauagccgauguccuacccaaggagaagcauaucuagauaaacaaucagacacucaauauguaugcaaacgaacauuaguugacagaggaugggggaauggauguggacuauuugggaaaggaucucuaguaacaugugcaaaauuugcuuguagcaagaaaaugacagguaaaucaauacaaccagaaaauuuagaguaucgaauuaugcuaagugugcauggaucacaacauucggguaugauaguaaaugacacuggacaugaaacugacgaaaauagagcgaaagucgaaauaacaccaaauuccccaagagcggaagcuacucuaggaggcuucggaagucuggguuuagauugugaaccuagaaccggacuagauuucucugauuuauauuauuuaacaaugaauaauaaacauugguuaguacauaaagagugguuucaugauauuccacuaccauggcaugcuggugcggauacaggaacuccacauuggaacaauaaagaagcauuaguugaauuuaaagacgcacaugcuaaacgacaaacagucguaguacuaggaagucaagaaggagcuguucacacagcucuagcaggagcauuagaagcagaaauggauggagcaaaaggaagauuaucaaguggacaucuaaaauguagauuaaaaauggacaaacuuagauuaaaaggaguaucuuauucucuauguacagcugccuuuacauuuacaaaaauaccugcugagacauuacacggaacaguuacaguugaaguucaauaugcaggcacugauggaccauguaaggucccagcucaaauggcaguagauaugcaaacauuaacaccaguuggaagauuaauaaccgcaaauccuguaauaacagaaagcacagaaaauucaaaaaugauguuagagcuagauccaccauuuggagacucauacauaguaauaggaguaggugaaaagaaaauuacacaucauuggcauagaucaggaaguacaauagguaaagcauuugaagcaacaguaagaggagcaaaaagaauggcaguccuuggcgauacugcaugggauuuuggaucaguuggaggagcacuaaacucucuaggcaagggaauacaucaaauauuuggagcagcuuucaaaaguuuauuuggaggaaugucaugguuuucucaaauacuaauaggaacauuacuuaugugguuaggacuaaauacuaaaaacggcaguauaucucuaauguguuuagcauuaggagguguuuuaauauuucuuucuacagccguaucggcagauguuggaugu

SEQ ID NO: 2521 - RNA, 2079 nt, Artificial Sequence
  ZIKV prME variant CDS opt
gcugacacaucaguuggaauaguaggacuauuauuaacaaccgcaauggcagcagaaguaaccagaagaggaucagccuauuauauguaucucgauaggaacgacgcaggcgaagcaauaucauuuccuacaacacuagguaugaauaaauguuauauucaaauaauggaucugggacauaugugcgacgcaaccauguccuaugaauguccuauguuagaugaagguguagagccagaugauguugacuguugguguaauacaacuaguacuuggguaguauacggaacaugucaucauaaaaaaggagaggcccgaagaucaaggagagccguaaccuuaccaagucauucaacaagaaaauuacaaacuaggagucagacuuggcuagaaagucgagaauauaccaaacauuuaauacgaguagaaaauuggauuuuucgaaauccaggauuugcacuugcugcugcugcgauugccugguuacuuggaagcucaacaagucaaaaaguaauuuauuuaguuaugauauuauuaauagcaccagcuuacagcauuagauguauaggagugucaaauagagacuuuguagagggcaugaguggagguacguggguagauauaguauuagaacauggaggaugcgugacaguaauggcacaagacaaaccaacgguagauauagaauuaguaacaacuaccguaucgaauauggcagaaguacgaucauauugcuaugaagcaucaauaagugauauggcuuccgacagcagaugcccuacucaaggagaagcauacuuagauaagcaaagugauacccaauauguuugcaaacgcacacuaguagauagaggaugggguaauggaugugguuuauuuggcaaaggaagucugguaacaugugcuaaauuugcaugcucaaaaaaaaugacaggaaaaucaauacaacccgaaaauuuagaauauagaauaauguuaagugugcaugguucacaacauagcggaaugauuguaaaugauacuggacaugaaacagaugaaaauagagcaaaaguagaaauaacaccaaacaguccaagggcggaagccacacuagguggauuugguucauugggacuagacugugaaccgcgaacuggcuuagauuuuagcgauuuauauuauuuaacaaugaauaacaaacauugguuaguacacaaagaaugguuccaugacauuccacuuccauggcacgcuggcgcagauacuggaacaccucacuggaauaacaaagaagcacuaguggaauucaaggacgcacacgcaaaaagacaaacaguaguaguucuaggaucacaagaaggagcaguacauacagcuuuagcgggagcauuagaagcagaaauggauggagcaaaaggaagacuaucaagcggacaucuaaaauguagguuaaaaauggacaaacuaagauuaaaaggagugucauauaguuuauguacagcagcauucacuuuuacaaaaauuccagcugaaacauuacaugguacaguaacaguugaaguucaauaugcuggaacagauggaccauguaaaguaccagcacaaauggcaguagacaugcaaacacuaacacccguuggccggcuaaucacagcaaauccaguaauuacagaaucaacugaaaauucaaaaaugauguuagaauuagauccacccuuuggagauaguuacauaguaauaggcguaggagaaaaaaaaauuacacaucauuggcauagaucugggucaacaauuggaaaagcguuugaagcaacaguaaggggcgcuaaacguauggcaguucuaggagauacggcuugggauuucggcucaguaggaggagcacuaaauucauuaggaaaaggaauacaucaaauuuuuggagcagcauucaaaucauuauuuggaggaaugagcugguucucacaaauuuuaauaggcacauugcuaauguggcuaggauuaaauaccaaaaaugguucaauauccuuaauguguuuagcauuaggaggaguuuuaauauuuuuaaguacagcaguaucagcagacguuggaugu

SEQ ID NO: 2522 - RNA, 2076 nt, Artificial Sequence
  ZIKV prME variant CDS opt
gauacaucaguugguauaguaggacuauuguuaacaacagcaauggcggcagaaguaacaagaagaggaucagcguacuacauguaucuagauagaaacgaugcaggugaagcaauaucauucccaacgacccuaggcaugaacaaauguuauauacaaaucauggaucuaggucauaugugugaugcaacaaugucuuaugaaugucccauguuagaugaaggcguagagccugaugacguagacuguugguguaauacaacaaguacauggguaguuuauggaacaugucaucauaaaaaaggagaagcaagaagaagcagacgagcugugacacuaccuucacacaguacaagaaaauuacaaacaagaucacaaaccugguuggaaagcagagaauauacaaaacacuuaauacgaguagagaacuggauuuuuagaaauccagguuucgcauuagcugcagcagcaauagcauggcuauuagguaguucaacaucucaaaaaguaauauauuugguaaugauauuacuaauagcuccagcuuauaguaucagauguaucggcguaucaaauagagacuuuguugaagguaugucaggaggaacaugggucgauauaguucuugaacaugguggauguguaacaguaauggcacaagacaaaccuacaguagauauagaauuaguaaccacaacaguaucaaacauggcugaaguaagaucuuauuguuaugaagcaagcauaucagauauggcaagcgacagcagaugcccaacacaaggagaagcuuaccuagacaaacaaagugauacucaguacguauguaaacggacacuuguggauagagguuggggaaacggauguggauuauuuggaaaaggcaguuuaguaacaugcgcaaaauuugccuguucaaaaaaaaugaccggaaaaucaauacagccagaaaaucuagaauaccguauaauguuaaguguacaugguagucaacauagugggaugaucguaaaugauacaggacaugaaacagacgaaaacagagcgaaaguagaaauuacaccuaauucaccaagagcagaagcaacauuagguggauuuggcucacuuggauuagauugcgaaccaagaacuggacuagauuuuucagauuuauacuauuuaacaaugaauaauaaacauugguuaguucacaaagaaugguuucaugauauaccucuaccuuggcacgcgggagcagacacaggaacaccucacuggaauaauaaagaagcuuuaguugaauuuaaagaugcucacgcaaaacgacaaacuguaguugucuuagguucucaagaaggagcaguacauacugcauuagcaggcgcucuagaggcagagauggauggagcaaaagguagauuaucgaguggacauuugaaaugcagauuaaaaauggacaaauuaagguuaaaaggaguaaguuacucauuauguacagcagcauuuacauuuacaaaaauaccagcagaaacauuacacggaacuguaaccguugaaguacaauaugcagguacagauggaccaugcaaaguaccagcacaaauggccguagacaugcagacauugacuccaguaggaagauuaauaacagcaaauccaguaauaacugaaagcacggaaaauaguaaaaugaugcucgaauuagauccaccauuuggagauaguuacaucguaaucggaguuggcgaaaaaaaaauuacacaccacuggcauagaucugguucaacaauaggaaaagcauucgaagcaacaguacgcggagccaaacgaauggcaguuuuaggagauacagccugggauuuuggcaguguaggaggcgcucucaauagucuuggaaaaggaauacaucaaaucuuuggagcagccuuuaagagucuguucggaggaaugaguugguucucacaaauacuaauagguacguuauuaauguggcuaggauuaaacacaaagaaugguucaauaucuuugaugugucuagcuuuaggaggcguacucaucuuuuugucaacagcaguaucagcugauguaggaugc

SEQ ID NO: 2523 - RNA, 2073 nt, Artificial Sequence
  ZIKV prME variant CDS opt
acaaguguaggaauuguaggauuacuacuaacaacagcuauggcagcagaaguaacaagaaggggcucagcauauuauauguauuuagauagaaacgaugcuggggaagcaauaagcuucccuacaacauuaggaaugaacaaauguuacauacaaauuauggacuuagggcauaugugugaugccacaaugucuuaugaaugcccaauguuagaugaaggaguagagccugacgauguagacuguugguguaauacaacaucaacuugggugguauauggcacaugucaucauaaaaaaggcgaagcacgaagauccaggagagcuguaacacuaccaucacauaguacaagaaaauuacaaacaaggucucaaacaugguuagaaucucgcgaauauaccaaacaccuuauaagaguagaaaauuggauauucagaaauccaggcuucgcacuagcagcugcagcuauagcaugguuauuaggaucguccacaucacaaaaagucauauauuuaguaaugauacuauuaaucgcaccagcauauucaauaagguguauaggagugucaaacagagauuuuguugaaggaauguccggaggaacauggguggacauaguucuugaacacggaggauguguuacaguuauggcucaagauaaaccaaccguugacauagaauuaguaacaacaacuguaaguaauauggcagaaguaagaaguuacuguuaugaagcaagcauaucagauauggcaucagacucaagaugcccaacacaaggugaagcauauuuggauaaacaaucagauacacaauauguauguaaaagaacacuaguagauagagguugggggaacggauguggauuauuuggaaaaggcagcuuaguaacaugugcaaaauuugcaugcagcaaaaaaaugacaggaaaaucuauacaaccagaaaaucuagaauacagaauaauguugucaguacaugggucacaacauucaggaaugauaguaaacgauaccgggcacgaaacagacgagaaccgagcgaaaguugaaauaacaccaaacagcccaagagcugaagcaacauuagggggauucggcucauuaggacuagauugcgagccaagaacaggauuagacuuuucagaucuguauuauuuaacaaugaacaauaaacauugguuaguucauaaagaaugguuucacgauauuccauuaccauggcaugcgggagcagauaccggaacaccacauuggaauaacaaagaagcuuuaguagaauucaaagacgcacaugcaaaaagacaaacaguuguaguauuagguagccaggaaggggccguacauacagcacuugcaggagcauuagaggcagaaauggauggugcuaaaggcagacuaaguaguggacaucuaaaauguaggcuaaaaauggauaaauugagacucaaaggagucucauauagucuauguaccgcagcauucacauuuacaaaaauaccugcagaaacacuucauggaacaguaacuguugaaguacaauacgcagggacugauggaccauguaaagucccagcacaaauggcaguagauaugcaaacauuaacaccuguugguagguuaauaacagcaaacccugugauaacugaaucuacagaaaacagcaaaaugauguuagaguuagacccaccauuuggagauaguuauauagucauaggaguaggcgaaaaaaaaauaacucaucauuggcacagaucaggcaguacgauagguaaagcauuugaggcaacaguacgcggagcgaaacgaauggcaguacuaggagauacagcaugggauuucggcucaguuggaggagcauuaaauucacuuggaaaaggcauacaccaaauauuuggugcagcauucaaaagccuauuuggaggaaugucaugguuuagucaaauauuaauaggaacauugcuaauguggcuuggauuaaauacaaaaaauggauccauaucacuaaugugccuagcauuaggaggaguauuaauauuccuaucuacggcagugagcgccgauguaggaugc

SEQ ID NO: 2524 - RNA, 2073 nt, Artificial Sequence
  ZIKV prME variant CDS opt
acuagcguaggaauagucggacuucuauugacaaccgcuauggcagcagcaguuacaagaagaggcuccgcauauuacauguaccuagacagaaaugaugccggagaagccauaagcuuuccaacaacacuaggaaugaauaaauguuacauucaaaucauggaucucggacauaugugugaugcaacaaugaguuaugaauguccaauguuagacgaaggaguagaaccugaugaugucgauugcuggugcaauacaacaucaacaugggucguauauggcacuugccaccauaaaaagggagaagcuaggcguucacgaagagcaguaacacuaccaucccauucaacuagaaaauuacaaacccgaagucaaacuugguuagaauccagagaauauacaaaacacuugauaagaguagaaaauuggauauuuagaaauccagguuucgccuuagcagcugcagcaauugcaugguuacuaggaagcucaacaucacaaaaaguuauauacuuaguaaugauacuauuaauagcuccagcuuacucaauaagauguauaggaguuucaaauagggauuucguagaagggaugucaggagguacaugggucgacauaguauuagaacauggaggaugcguaacaguuauggcucaagauaaaccaacggucgauaucgaacuuguuacaacuacaguaucuaauauggcagaaguaagaaguuauuguuaugaggcaucuauaagugauauggcuagugauaguagauguccaacacaaggugaagcauacuuagauaaacaaucugacacacaauauguuuguaaaagaacacuaguagaccgaggauggggcaacggguguggauuauuuggaaaaggaaguuuaguaacaugcgcaaaauuugcauguucaaaaaaaaugacaggaaaaucgauucaaccugaaaaucuagaauauagaaucaugcuuucaguucacggaucacagcauaguggaaugauaguaaaugauacaggucacgaaacggacgaaaauagagccaaaguagaaauaacuccgaauucaccaagagcggaagccacucuuggcggauuuggaucauuaggauuagauugugaaccaaggacaggacuagauuucucagaucuauauuaccuuacaaugaauaacaaacauugguuaguacacaaagaaugguuucaugauauaccacuaccuuggcacgcaggagcugauacugguacaccacacuggaacaacaaagaagcguuaguagaauuuaaagaugcacaugcaaaaagacaaaccguaguaguacucggaagccaagaaggagcaguacauacagcucuagcuggagcauuagaagcagaaauggacggagcaaaaggaagauuaucuaguggccaccuuaaauguagauuaaaaauggauaaguuaagacucaaagguguaucauacucauuauguacugcugcauuuacauucacgaaaauaccugcagaaacacuacauggaacuguaacuguugaaguccaauaugcagguacagauggaccauguaaaguaccagcacaaauggcugucgauaugcaaacguuaacuccuguaggacgauuaauaacagcaaauccaguuauaacggaauccacagaaaacucaaaaaugauguuagaauuagauccaccauuuggagauucauauauaguuaucgguguuggagaaaaaaaaauaacucaucauuggcauagaagugguucaaccauaggaaaagcauuugaggcaacuguaagaggagcaaaaagaauggcugugcugggagauacagcuugggauuuuggaagugugggcggagcauuaaauagcuuagguaaagguauacaucaaauauuuggagcagcauuuaaaucacuauuugguggaaugucaugguuuagucaaauacugauagguacucuuuugaugugguuaggauuaaauacaaaaaauggaagcauaaguuuaauguguuuagcauuaggaggaguauuaauauuucuaagcacagcaguaucagcugacguaggaugu

SEQ ID NO: 2525 - RNA, 2085 nt, Artificial Sequence
  ZIKV prME variant CDS opt
agaggagcagauaccaguguaggaauaguaggucuauuauuaacaacagcuauggcagcagccguaaccagaagaggaagugcauauuauauguaccuugacaggaaugaugcgggugaagcaauuaguuuuccaacaacacuugggaugaauaaauguuauauucaaauuauggaucuuggucauaugugugaugcaacaaugagcuacgaauguccuaugcucgaugaaggaguagaaccagaugauguagauuguugguguaauacaacgagcacuuggguaguauauggaaccugccaucauaagaaaggggaagcuagaagaaguaggagagcaguaacacugccaucacauucgacaagaaaacuacagacaagaagucaaacaugguuggaaaguagagaauacacaaaacauuuaauuagaguagaaaacuggauauuuagaaauccuggauucgcauuagcagcagccgccauagcuugguuguuaggaaguagcacaagucaaaaagugauauauuuaguuaugauauuacuaauagcuccugcauauaguauaagaugcauaggaguaaguaauagagacuuuguugaagguauguccgggggaacauggguagacauaguacuagaacauggaggauguguuacaguuauggcacaagauaaaccuacaguggauauugaacuuguaacuacaacggucucaaauauggcagaaguacgaucauauuguuacgaagcaaguauaucugauauggcaucugacucaagaugcccaacgcaaggagaagcauaccuugauaaacaaagugauacacaauacguaugcaaaagaacucuaguagacagaggauggggaaauggcuguggauuauucggcaaaggaucucuuguuacaugcgcaaaauuugccugcucgaagaaaaugacaggaaaaaguauucaaccagaaaauuuagaauauagaauaauguuaagugugcacgguucacaacauuccgguaugaucguaaacgauacaggacaugaaacagaugaaaauagagcuaaaguagagauuacaccaaauaguccacgagccgaagcaacacucggcggauuuggcaguuuagguuuagauugcgaaccgagaacagguuuagauuuuucagauuuauauuauuuaaccaugaacaauaaacauugguuaguccauaaagaaugguuucacgacauaccucuaccauggcaugcaggagcagauacagguaccccucauuggaauaauaaagaggcuuuaguagaauuuaaagaugcacacgcaaaaagacaaacagugguuguauuagguagccaagaaggugcaguacauacagcucuagcaggagcauuagaagcggaaauggauggugcaaaaggaagauuaaguucagggcacuuaaaauguagauuaaagauggacaaguuacgauuaaaaggaguaucauauagccuauguacagcggcauuuacauuuacuaaaauaccagcagaaacacuacacggaacaguaacaguugaaguacaauaugcuggaacagauggccccuguaaaguaccagcacaaauggcaguagacaugcaaacacuaaccccaguaggaagauuaauaacagcaaauccgguaauuacugaaucuacugaaaauagcaaaaugaugcuagaauuagauccaccauucggcgacagcuauauagucauaggggugggagaaaagaaaauuacacaucauuggcacagaucaggaaguacuaucgguaaagcauuugaagcaacaguaagaggagcuaaaagaauggcaguacuaggggauacagcaugggacuuuggaagugucgguggagcacuaaauucuuugggaaaagggauacaccaaauauuuggugcagcauuuaaaaguuuauucgguggaaugucuugguucagucagauacuaauuggcacucuuuuaaugugguuaggucuaaauacgaaaaaugggucaauaucucuaaugugucuagcauuaggagguguuuuaaucuucuuaagcacagcaguaucagcagacguaggaugu

SEQ ID NO: 2526 - RNA, 2109 nt, Artificial Sequence
  ZIKV prME variant CDS opt
cgaggacugucaucaagaaaaagaagaucacaugauguacuuacaguacaauucuuaauauuaggaauguuacuaaugacaggaggcguaacaagaagagguagcgccuacuauauguaucuagauagaaaugaugcaggagaagcaaucaguuucccuacaacccuugguaugaauaaaugcuauauacaaauaauggauuuggggcacaugugugacgcuacaaugaguuacgaauguccaauguuagaugaaggagucgaaccagaugauguagauugcugguguaacaccacaucaacaugggugguauacgggacaugccaucauaagaaaggagaagcaagacguucaagacgagcuguaacauuaccaagucauagcacaagaaaauuacaaacuagaucacaaacaugguuagaaucccgagaguacacaaaacaucuaauaagaguggaaaauuggauuuuuagaaauccagguuucgcauuagcugcagccgcuauagccugguuauuagguucaucuacaagucaaaaaguaauauauuuaguaaugauauuacuaauagcaccagcauauucuauaagauguauaggagucucaaauagagauuucguagaagguaugagcggaggaacuuggguagauauuguacuagaacaugguggcuguguaacaguaauggcucaagauaaaccuacaguagauauagaauuaguaacaacgacaguaucaaauauggcagaaguuagaucuuauuguuacgaagcaagcaucucagauauggcaagugacaguagaugcccaacacaaggggaagcauaucuagacaaacaaucagacacucaauauguauguaaaagaacuuuaguugaccgaggauggggaaaugguuguggacuauucgguaaaggaucauuaguuacuugugcgaaauucgccugcagcaagaaaaugacaggaaaaucaauccaaccagaaaacuuagaauacagaauaaugcuaaguguacauggaagccagcacaguggaaugauaguaaaugauacaggccaugaaacagaugaaaauagagcaaaaguagaaauaacaccaaauucaccgagagcugaggcaacacuaggaggauuugggagcuuaggauuagauugugaaccaagaacaggccuagacuuuagcgauuuauauuacuuaacaaugaauaauaaacacuggcuaguacacaaagaaugguuucaugacauaccuuuaccauggcaugcaggagcagacacugguacaccacauuggaacaauaaagaagcauuaguagaauuuaaagacgcccaugcgaaaagacaaacgguaguaguacuaggaagucaagaaggggcaguacauacagcuuuagcuggugcauuagaagcugaaauggauggagcaaaagguagacuauccucaggucacuuaaaauguagacuaaaaauggacaaauuaagguugaaaggaguaucauacaguuuauguacagcagcauuuacauuuacuaaaauaccugcagagacacugcauggaaccguuacaguggaaguacaauacgcaggaacagauggaccauguaaaguaccagcacaaauggcgguagauaugcaaacacuaaccccgguagguagauuaauaacagcaaacccugugauaacagaaagcacugaaaacucaaagaugauguuagaauuagacccaccauucggugauaguuauauaguaauaggagucggagaaaagaaaauaacacaucacuggcauagaagugguucaacaauagguaaagcguucgaagcaacaguucgaggagcaaaaagaauggccguacuaggagauacugcaugggacuuuggaucaguaggaggagcuuuaaacucucuagguaaagguauucaucaaauauucggggcugcuuuuaagagcuuauuuggcggaaugucuugguuuucacaaauauuaauaggaacacuauuaauguggcuaggacuaaauacgaaaaauggaagcauaagucugauguguuuagcacugggaggaguacucaucuuccuaagcacagcaguuucagccgauguaggaugu

SEQ ID NO: 2527 - RNA, 2109 nt, Artificial Sequence
  ZIKV prME variant CDS opt
cgaggacuaucaucaagaaaaagaagaucacaugacguccuuacaguacaauuuuuaauauuaggaauguuauuaaugaccggagcaguaacuagacgaggaucagcauauuacauguaccuagaccgaaaugacgcaggagaagcuauaucauuuccuacaacccuaggaaugaacaaauguuacauacaaauaauggauuuaggacauaugugugaugccacaaugucauaugaauguccaaugcucgaugaaggaguagaaccggaugacgucgauuguuggugcaacacaacuucgacuuggguaguauacgguacuugucaucauaagaaaggagaagcgagacguucaaggagagcagugacacuaccgucucacucaacaagaaaauuacaaacaagaucacaaacgugguuagaaagcagagaauauacaaaacacuuaaucagaguggaaaauuggauauuuaggaacccaggcuucgcuuuagcagcggcagcaauagcaugguuacuaggauccagcacaucacaaaaaguaauauacuugguaaugauauuacuaauugcuccagcauacucaauuagauguauagguguaaguaacagagauuucguugaaggaaugaguggaggaacaugggucgauauaguacuugagcauggcggaugcguaaccguaauggcacaagauaagccaacuguagauauagaacugguuacaacaacagucucuaauauggcagaaguaagaagcuauuguuaugaagcgucaauaucagauauggcgucagacucaagaugccccacccaaggagaagcauaucuagauaaacaaagugacacacaauauguaugcaaaaggacucuaguagauagaggauggggaaauggguguggauuauucggaaaagggucccuaguaacaugcgcaaaauuugccugcucaaagaaaaugacagggaaaucaauucaaccagaaaaccuagaauacagaauaauguuaagcguucauggaagucaacauucggguaugauuguaaacgauacaggacaugaaacugacgaaaauagagcgaaaguugaaauaacaccuaauucaccaagagcagaagcaacucucggaggauucggaagucuuggacuggauugcgaaccacgaacaggguuagauuuuagcgaccuauauuaucuaacgaugaauaacaaacauugguuaguacacaaagaaugguuucaugacaucccacuaccauggcaugcaggagcagacacagguacgccacauuggaauaacaaagaagccuuaguagaauuuaaggaugcacaugcaaaaaggcaaacuguaguugucuuaggaagccaagaaggcgcaguacauacagcauuagcuggagcuuuagaggcugaaauggauggagcaaaagguagguuaucaaguggacauuuaaaaugucgauuaaaaauggauaaauuaagguuaaaaggaguaucuuauucauuaugcacagcagcauuuacauuuacaaaaauaccagcagaaacccuacaugguacaguaacaguagaaguccaauaugcaggcacagauggaccaugcaaaguuccagcucaaauggccguagauaugcaaacuuuaacacccguuggaagacuaauaacagcaaauccaguaauaacagaaucaacagaaaauaguaaaaugaugcuagaacuagaucccccauuuggcgauagcuauauagucauaggggucggagaaaagaaaauuacacaucacuggcaucgaucaggcaguacaauagguaaagcauuugaagcaacaguacgaggagcuaaaagaauggcaguccuaggagauacagcuugggacuuugguucaguaggaggagcauuaaacucauuaggaaaagguauacaucaaauauuuggagcagcuuucaaaucauuauuuggaggcaugucuugguuuagucagauacuaauaggaacucuauuaaugugguuaggcuuaaauacuaaaaauggaagcauaucuuuaaugugucuagcuuuagguggaguauuaauauuuuuaagcacagcuguaucagcugauguaggcugu

SEQ ID NO: 2528 - RNA, 2109 nt, Artificial Sequence
  ZIKV prME variant CDS opt
aggauaauaaaugcccgcaaagaaaagaaacggagaggagccgauacaucuguagguauuguaggauuauuauuaacaacagcgauggcagcagaaguaacaagaagaggaucagcuuauuauauguauuuagacagaaacgaugcaggagaagcaauuagcuuuccaacuacauuagguaugaauaaauguuauauacaaauaauggauuuaggacauaugugugaugcgacaauguccuaugaauguccaaugcuagaugaagguguagagccagaugauguagauugcugguguaauacaacaucaacaugggucguauauggaacaugccaucauaagaaaggugaagcaaggcguaguaggagagcaguuacauuaccaucucauucuacuagaaaacuacaaacaagaucacaaacaugguuagaaagucgagaauauacuaaacauuuaauaagaguagaaaacuggauuuuuagaaacccaggauuugcacuagcugcagcugcaauagcaugguuguugggaagcaguacaagucagaaaguaauuuauuuaguaaugauauuauuaauugcaccagcauauucaauuagauguauagguguaucuaacagagacuuuguagagggcaugucaggaggaacauggguugauauuguuuuagaacaugguggauguguaacuguaauggcucaagauaaaccaacaguagacaucgaauuagugacuacaacaguaucaaacauggcugagguuagauccuauuguuaugaagccucaaucagcgauauggccagugauaguagauguccaacacaaggugaagcauauuuagauaaacaaagugauacgcaauauguuuguaaaaggacguuaguagaucggggcuggggaaacggaugcggcuuauuuggaaaaggaaguuuaguaacaugugcaaaauuugcaugcucaaagaaaaugacagguaaaagcauucagccugaaaauuuagaauauagaauaaugcuaaguguacauggcagucaacauucaggaaugauuguaaaugacacgggacacgaaacagacgaaaacagagcaaaagucgaaauaacgccuaauaguccaagagcagaagcaacuuuagguggauuuggaagccuuggacuagauugugaaccacgaacugguuuggauuucagugauuuauacuauuuaacuaugaauaacaaacacugguuaguacauaaagaaugguuucaugacaucccauuaccauggcaugcaggagcggauacugggacaccacauuggaacaauaaagaggcguuagucgaguucaaagaugcacaugcgaaacgacagacaguaguaguauugggaagucaagaaggagccguacacacagcauuagcuggagcauuagaagcugaaauggacggagcaaaaggaagauuaucaucuggacacuugaaauguagauuaaaaauggauaaacucagacugaaaggaguaagcuacagucuauguacagcagcauucacauuuacaaaaauuccugcagaaacacuacauggaacaguuacaguagaaguacaauaugcaggaacagauggaccauguaaaguaccggcacaaauggcuguagacaugcaaacacuuacgccuguaggaagguuaauuacagcaaacccugugauaacagaaaguacggaaaauucaaaaaugauguuagaacuagacccuccauucggugauaguuauauagucauaggaguaggugaaaagaaaauuacacaccauuggcaucgcucaggcucaacaauaggaaaagcguuugaagcgacaguaaggggagcaaaaagaauggcaguguuaggggauacagcaugggauuucggaucgguaggaggugcauugaauagucuaggaaaagguauucaccaaauauuuggagcagcguucaaaucauuauuuggggguaugaguugguucucacaaauauuaauagggaccuuauuaauguggcuaggacuaaauacgaaaaaugguucaauuagucucauguguuuagcauuagguggaguauugauauuccuaaguacagcaguauccgcagau

SEQ ID NO: 2529 - RNA, 2106 nt, Artificial Sequence
  ZIKV prME variant CDS opt
auaauuaacgcaagaaaagaaaaaaagagaaggggggcagacacaucuguaggaaucguaggguuauuauuaacaacagcuauggcagccgaaguaacgcgaagaggaucagcuuauuauauguauuuagacagaaacgaugcaggagaagcaauaaguuuuccaacuacucuaggaaugaauaaauguuacauacaaauaauggauuuaggacacaugugugacgcaacaaugagcuaugaaugcccaauguuggaugaaggcguagagcccgaugauguggauuguugguguaauacaacaagcacuugggugguauauggcacuugccaucacaaaaaaggcgaagcaagaaggucuagaagagcaguaacauuaccaucccacucaacaagaaaauuacaaacaagaucccaaacauggcuagaaucuagagaauauacaaaacauuuaauucgcguagaaaauuggauauucagaaauccgggguuugcacuagcagcagcugcaauagcauggcuauuaggaucaucgacaagccaaaaaguaauauauuuaguaaugauacuacucauagcaccugcauacucaauaagauguaucgguguaucaaauagagauuucguggaaggcaugagugguggaacauggguugacauaguuuuagaacauggagguuguguuacuguaauggcucaagauaaaccaacaguagauauagaacucguaacaacaacaguuucaaauauggcggaaguaagaaguuauuguuaugaagcuucuauuucagauauggccagcgacagucguugcccaacacaaggugaagcauaucuagacaagcaaagugauacucaauauguaugcaaaagaacacuaguagacagagguugggguaauggaugugguuuauuuggaaaaggaagccuaguaacaugcgcaaaauuugcuugcaguaaaaaaaugacagggaaaaguauacagcccgaaaaccucgaguauagaauaauguuaucuguacauggaucacaacacagcggaaugauaguaaaugauacaggacacgaaacagaugaaaacagagcaaaagucgaaauaacaccaaauaguccucgagcugaagcuacauuaggaggauucggaucgcuaggguuagauugcgaaccuagaacuggauuagacuuuucugauuuauauuaccugacaaugaacaacaaacacuggcuuguacauaaagaaugguuccaugauauuccauuaccauggcaugccggagcagauacaggaaccccccauuggaauaauaaagaagcauuaguagaauucaaagacgcgcacgcuaaaagacaaacaguaguaguacuaggaucacaagaaggagcuguacauacagcauuggcaggagccuuagaagccgaaauggacggagcaaaaggucgucuuucaagcggacauuugaaauguagacuaaaaauggauaaacucagacuaaaagggguaucauauucacuauguacagcagcauuuacauuuacaaaaauaccagcagaaacauuacaugguacagucacaguagaaguucaauaugcaggaacagaugguccguguaaaguaccugcacaaauggcaguagauaugcagacauuaacaccgguugguagguuaauuaccgcaaauccaguaauaacagaaaguacagaaaauucaaaaaugauguuagaauuagauccaccauuuggagacagcuauauaguaauaggaguaggugaaaaaaaaauaacacaucauuggcauagaaguggaucaacaauaggaaaagcauuugaagcaacggucagaggagcaaaaagaauggccguuuuaggggauacagcaugggauuuuggaaguguagguggagcauuaaacucuuuagguaaaggcauacaucaaauauuuggagcggcuuuuaaaaguuuauucggugguaugucaugguuuagucaaauacuaauaggaacuuuauuaaugugguugggauuaaauacaaaaaacgguucgauuaguuuaaugugcuuagcauuaggcggaguauuaauauucuuaaguacggcgguaagugcugau

SEQ ID NO: 2530 - RNA, 2103 nt, Artificial Sequence
  ZIKV prME variant CDS opt
auaaaugcaaggaaagaaaaaaaaagaagaggagcagauacauccguuggaauaguuggacugcuauuaacaacagcuauggcagcagagguuacacgaagaggaagcgcauauuauauguaucuagauagaaaugaugcaggagaagcuauaaguuuuccgacaacauuaggaaugaauaaauguuauauacaaauaauggaccuaggacauaugugugaugcaacaaugaguuaugaauguccaauguuggacgaaggaguagaacccgacgacguagauuguugguguaauacaacaagcaccuggguaguauauggcacaugucaccauaagaaaggagaagcaagaagaucacgaagagcgguaacauuaccaucacauucuacacgaaaauuacaaacaaggucacaaacaugguuagaaagcagagaauauacaaaacauuuaauucgaguggaaaauuggauauuuagaaauccaggauuugcacuagccgcagcagcaauagcaugguuacuaggaucaucaacaucacaaaaaguaauauauuuaguaaugauacuacuuauagcaccagccuacucaauuagaugcauuggaguaucuaauagagauuucguagaaggaaugagcggaggaacuuggguggauauuguauuagaacacggaggauguguaacaguaauggcucaagauaagccaacaguagacauagaauuaguaacaacuacaguaaguaauauggccgaggucagaagcuacugcuaugaagcaucaauuucagauauggcaagcgauucaagauguccaacacaaggugaagcuuauuuggacaaacaaagugacacacaauauguaugcaaacgaacacugguagaucgcggauggggaaauggauguggauuauuuggaaaagggucauuaguaacaugugcaaaauucgccuguucaaaaaaaaugacuggaaaauccauucaacccgaaaaucuagaauauagaauaauguuaaguguacauggaucacaacauucugguaugauaguaaaugauacaggucaugaaacagaugaaaaccgcgcaaaaguagaaauaacaccuaacucaccuagagcagaagcaacacuaggaggauuuggaagcuuaggguuggacugugaaccuagaacaggacuggacuuuucugacuuauauuaucuaacaaugaacaauaaacauugguuaguacauaaagaaugguuccaugauauaccauuaccauggcaugcaggagcugauacaggaacaccucacuggaacaauaaagaagcacucguagaauuuaaagaugcccaugcgaaaagacaaacuguaguaguuuuaggaucccaagaaggcgcuguacacacugcacuagcuggggcauuagaagccgaaauggacggugcaaagggacgauuaucauccggacauuugaaaugucguuuaaaaauggacaaauuaagacuaaaaggaguaucguauucacuauguacagcagccuuuacuuuuacaaaaauaccagcagaaacauuacauggaacaguuacaguugaaguacaauaugccggaacagacggaccaugcaaaguuccagcacaaauggcuguagauaugcaaacauuaacuccaguaggcagauugauaacagcaaacccugucauaacagaaucaacugaaaacaguaaaaugaugcuugaacuagaccccccauuuggagacucauacauaguaauagggguaggugaaaaaaaaauaacacaccauuggcauagaaguggauccacaauagguaaagccuuugaagcaacuguacguggagcaaaaagaauggcagucuuaggggauacagcaugggauuuuggaucaguaggaggagcuuuaaacucuuuaggaaaaggaauacaucaaauauuuggagcagcauucaaaucacuuuuuggaggaaugucaugguuuucucaaauucuaaucgggacacuacuuauguggcuaggauuaaauaccaaaaacggcaguauaucacugauguguuuggcauuagguggaguuuuaauauuuuugagcacagcggugucagcagau

SEQ ID NO: 2531 - RNA, 2100 nt, Artificial Sequence
  ZIKV prME variant CDS opt
aaugcgaggaaagaaaagaaaagaagaggugcagauacaucagucggaauaguaggacuguuauugacaacagcgauggcagcagaaguaacaagaagaggaagcgcauauuauauguacuuagauagaaacgaugcuggugaagcaauaucauuuccuacaacauuaggaaugaacaaauguuauauacaaauaauggauuugggacauaugugugaugcuacaaugaguuaugaauguccaauguuggaugaaggaguagagccagacgauguagauuguugguguaacacaacaucaacauggguaguauaugggacuugucaccauaagaaaggggaagcucgacgaagccguagagcgguaacgcuaccaagccauagcacaagaaaauuacaaacgagaagucaaacuugguuagaaagcagagaauacacaaaacauuuaauaagaguagaaaauuggauauucagaaacccaggguuugcacuagcggcggcugcaauagcauggcuccuaggaucaucaacaucacagaaaguaauauaccuaguaaugauacuacuaauagcuccugcauauaguaucagauguauaggaguaaguaaucgagauuuuguagaagguauguccgguggaacguggguagacauaguacuagaacauggaggauguguaacagucauggcacaagacaaaccgacaguagacauagaauuaguuacgacaacaguaucaaauauggcagaagugagaucuuauuguuacgaagcaagcauaagcgacauggcaagugacagccguuguccaacacaaggagaagcauacuuagauaaacaaagugauacacaauauguauguaaaagaacgcuaguugacaggggcuggggaaacggaugcggcuuauucggaaaaggaucucuaguuacaugugcaaaauuugcauguucaaagaaaaugacaggcaaaucaauacaaccggaaaauuuagaauauaggauaauguuaucagugcaugguucacaacauucaggaaugauaguuaacgauaccggucaugagacagacgaaaauagagcaaaaguagaaauaacacccaacucaccaagagcagaagcaacacuagguggauucgguagcuuaggauuagacugugaaccaaggacaggauuggauuuuagugaccuauauuaccuaacaaugaauaauaaacacuggcuaguacauaaagaaugguuucaugauauaccguuaccuuggcaugcuggugcugauacagggacuccacauuggaauaauaaagaagcauuaguagaauuuaaagaugcgcacgcgaaaagacaaacgguaguaguauuagggucacaggaaggagcaguacauacugcacuagcaggagcauuagaagcagaaauggauggagcuaaaggaagacucagcucagggcacuuaaaaugcagauugaaaauggauaaauuaagacuuaaagguguuaguuauucucucuguacugcagcauuuacuuucacuaaaauaccggcagaaacacuucauggcacaguaacagucgaaguacaguacgcaggaacagaugggccauguaaaguaccagcacaaauggcuguagauaugcaaacguuaacaccuguaggacgauuaauaaccgcaaaccccguaauuacagaaucaacagaaaacucaaaaaugaugcuugaauuagacccaccauucggagauagcuauauaguaauaggagugggagaaaagaaaauaacacaucauuggcauagaagcgguucuacaauagguaaagcauucgaggcaacgguuagaggggcaaaaagaauggcgguauuaggagacacagcuugggauuucggaagcguagguggagcauuaaauucacuuggaaaagguauacaucaaauauuuggagcagcauucaaaaguuuauucggagguaugucaugguuuagucaaauuuugauaggaacauuacugaugugguuaggguuaaauacuaaaaacggaagcauuagcuuaaugugucuugcucuaggaggcguauuaauauucuuaagcacagcaguuagugcagac

SEQ ID NO: 2532 - RNA, 2097 nt, Artificial Sequence
  ZIKV prME variant CDS opt
gcuagaaaagaaaagaaacgaagaggcgcagauacaucaguaggaauaguuggucuauuacuaacaacugcaauggcagcagaaguaaccagaaggggaagugccuauuauauguaucuugauaggaaugaugcuggugaggcaauaucauuuccuacaacucuuggaaugaauaaaugcuacauacaaauaauggauuuaggucauaugugcgaugccacaaugucauacgaaugcccaaugcuagaugaaggaguagaaccugaugauguagacuguuggugcaacacaaccaguacauggguaguauauggaacuugucaucacaagaaaggagaagcaagaagaaguagacgagcaguaacgcuaccaagccacucaacacggaaauuacaaacaagaagccaaacaugguuagaaagcagagaguauacgaaacaccucaucagaguagaaaacuggauauuuagaaacccgggauuugcauuagcagcagcggcaauagcauggcuauuaggaaguuccacaagucaaaaaguuaucuacuuaguaaugauacuuuugauagcaccagcauacucaauuagauguaucgggguuucuaauagagauuuuguagaaggaaugaguggagguacauggguagauauaguauuagaacacggaggaugugucacaguaauggcacaagauaaaccaacaguugacauagaauuagugacaacaacaguaagcaauauggcagaaguacgauccuacuguuacgaagcaaguauaagcgauauggcuagugacucacgauguccuacucaaggugaggcuuaccuagauaaacaaagcgauacgcaguauguaugcaaaagaacauuaguagacaggggaugggguaacggaugcgggcuauuuggaaaaggcucucuuguaacaugugcaaaauucgcuuguaguaagaaaaugacggguaaaucaauacaaccagaaaaucuagaauauagaauaauguuaaguguacauggaucucaacauagugggaugaucguaaaugauacaggucacgaaacagacgaaaacagagcuaaaguagaaauaacaccaaauagcccgagagcagaagcuaccuugggaggauuuggaagccuaggucuugauugugaacccagaacaggauuagauuucucagauuuauauuaccuaaccaugaauaauaaacauuggcugguacauaaagaaugguuucaugauauaccuuuaccauggcacgcgggggcagacaccgguacuccacacuggaauaauaaagaggcauuaguagaauuuaaagacgcacaugcaaaaaggcaaacaguagugguacuagguagccaagaaggagcaguacauaccgcauuagcaggagcacuagaggcugaaauggauggagcaaaaggaagacuaucaucaggacaucuuaaaugucgauuaaaaauggacaaauuaagauuaaaagggguaagcuauaguuuaugcacggcagcuuuuacauuuaccaaaauaccagcagaaaccuuacaugguaccguaaccguugaaguucaauaugcuggaacagacggaccauguaaaguacccgcacaaauggcaguagauaugcaaacacuaacaccaguugggcgacugauaacugcaaauccaguaauaacagagucaacagaaaacucaaagaugauguuagaauuagauccaccauuuggugauucauauauaguaauaggaguuggagaaaagaaaaucacacaucauuggcauagaagcggaaguacuauaggaaaggcuuuugaagcaacaguaagaggagcaaaacgaauggcagucuuaggagauacugcuugggauuucggaaguguaggaggagcuuuaaacagccucgguaaagggauacaucaaauauuuggagcagcauuuaaaaguuuauuuggaggaaugaguugguuuucacaaauauuaauuggcacauuacuuauguggcuagguuuaaauacgaaaaacggaagcauauccuugaugugcuuagcacuuggagggguacuaauauucuugaguacagcaguaagugcagau

SEQ ID NO: 2533 - RNA, 2094 nt, Artificial Sequence
  ZIKV prME variant CDS opt
agaaaagagaaaaaacgaagaggcgcagauacuaguguaggcaucguaggacuauuauuaacaacugcuauggcagcagaaguuacaagaagaggcagcgcauauuacauguauuuagaccgaaaugacgcaggagaagcuauuucauucccaacaacauuaggaaugaacaaauguuauauacaaauuauggacuuaggccacaugugugaugcaacaaugucauaugaauguccaauguuagaugaaggaguagaaccagaugauguagacuguuggugcaauacaacaaguacauggguaguauacgguacaugucaucauaaaaaaggugaagcaagaagaucuaggagagcaguaaccuuaccaucacauucaacaagaaaauuacagacaagaagucaaacgugguuagaaaguagagaauauacaaaacaucuaauuaggguagaaaauuggauauucagaaauccgggauuugcauuagcagccgcagcaauagcauggcuauuagggucuucaacaagucagaaaguaauuuaccuaguaaugauauuacuaauagcaccggccuacaguauacgguguauaggaguaaguaacagggauuucguugaaggaaugaguggagguacauggguagacauaguauuagaacaugguggauguguaacuguuauggcacaagauaaaccuacaguagacauugaacuaguuacaacaacaguuaguaacauggcagaaguaaggaguuauuguuaugaagcuucaauaagugauauggcaucagauucacguuguccuacacaaggagaagcuuauuuagauaaacaaagugauacacaauacguauguaaaagaacauuaguagaucgaggauggggaaaugguuguggucuauucggcaaagguucuuuaguaaccugugcaaaauuugcuugcagcaaaaaaaugacuggaaaaaguauccaaccagagaacuuagaauauagaauaauguuaaguguacauggaagccaacacucaggaaugauaguaaaugauacaggacaugaaaccgaugagaauagagcuaaaguagaaauaacaccaaacucaccucgagcugaagcaacauuaggaggauucggaucguugggauuagacugugaaccgagaacuggacuagauuuuucugauuuauauuauuuaacaaugaauaauaaacacugguuaguucauaaagaaugguuucaugauauaccauuaccuuggcaugcaggugcugauacuggaacaccacacuggaauaauaaagaagcauuaguagaauuuaaggaugcacacgcgaaaagacaaacaguaguaguuuuaggaagccaagagggagcaguacacacagcucuagcaggagcguuagaagcagaaauggauggugcaaaaggacgauuaucaucaggacaucuuaaaugucgacuaaaaauggacaaacugagacuaaaaggaguaucauauaguuuauguacagcagcguuuacauuuacuaaaauaccugcggaaacacuucauggaacuguuacgguagaaguacaauaugcaggaacugauggaccaugcaaaguaccggcccaaauggcaguagacaugcaaacuuuaacaccagucggaagauuaauaacugcaaaccccguaauaacagaaagcacugaaaacaguaaaaugauguuagaacuugaucccccauucggagauagcuauauaguuauaggcguaggagaaaagaaaauaacacaucauuggcacagaucaggaucaacaauaggaaaagcuuuugaagcuacagugagaggagcaaaaagaauggcaguauugggagauacagcuugggauuucgguucuguuggcggagcgcuaaauagucuaggaaaaggaauacaucaaauauucggugcugcauuuaaaucauuguucggaggcaugucaugguuuagccaaauuuuaauaggaacacuauuaaugugguuaggauuaaacaccaaaaauggcucuauuucacuaaugugcuuagcauuaggagguguauuaauauucuuaaguacagcgguuagugcggac

SEQ ID NO: 2534 - RNA, 2091 nt, Artificial Sequence
  ZIKV prME variant CDS opt
aaagagaaaaaaagaagaggagcagauacgucaguaggaauuguaggauuauuauugacaacagcaauggcagcugaagugacucguagaggaucagcauacuauauguauuuggaucguaaugacgcaggugaagcaauuucuuuuccuacaacauuagguaugaauaaguguuauauacaaauaauggacuuaggacacaugugugaugcaacaaugucauaugaaugcccuauguuagacgaagggguagaaccagacgauguugauuguugguguaauacuacaucaacauggguaguauacggaacaugucaccauaaaaaaggagaagcacgcagaaguagacgagcaguaacacuaccuucacauucaacaagaaaacuacagacgagaucacaaacuuggcuagaaaguagagaauacacaaaacaucuaauaagaguagaaaauuggaucuuuagaaauccagguuuugcguuagcagcagcagcaauagcuugguuguuagggucgucaacuagccaaaaaguaauauaucuaguaaugauauuauuaaucgcaccggcuuauaguauaagaugcauaggaguuaguaaucgagauuuuguagagggaaugucaggaggaacuuggguagauaucguucuagaacacggaggauguguaacaguaauggcacaggauaaaccaacaguugauauugaauuaguaacaacaacaguaagcaacauggcagaaguaaggaguuauugcuacgaagcuaguauaucagauauggcaagugauucaagauguccuacacaaggugaagcauauuuagauaaacaaagcgacacacaauaugucuguaaaagaacauugguugauagagguuggggaaaugguugcggauuauucggcaaagguucucuaguaacuugcgcaaaauuugcauguucaaaaaaaaugacagguaaaagcauacaaccagaaaacuuagaauauaggauuauguuaucgguucauggcucgcaacauagcgguaugauuguaaaugauacaggacacgaaacagacgaaaacagagcaaaaguagaaauaacuccaaauagcccaagagcagaagccacacuagguggauuugguaguuuaggacuagauugugaaccaagaacaggauuagauuuuagugaccuauauuauuuaacaaugaauaauaaacacugguuaguucauaaagaaugguuucacgauauuccauuaccuuggcaugcaggugcggacacaggaacgccacauuggaacaauaaagaagcuuuaguagaauucaaagaugcucaugcaaaaagacaaacaguaguaguacuaggaagucaagaaggagcgguacauacagcacuagcaggugcauuagaagcagaaauggauggagcgaaaggcagacuaucaucuggacaucuaaaauguagauuaaaaauggacaaacuaaggcuaaaaggaguaaguuacucacuauguacagcagcauucacauuuacaaaaauuccagccgaaacguuacacggaacaguaacggucgaagugcaauaugcaggaacugauggacccuguaaaguaccugcucaaauggcaguagauaugcaaacacuuacaccaguaggaagauuaauaacagcuaauccaguaauaacagaaucuacagagaacucaaaaaugaugcucgaauuagacccaccauucggugauaguuauauaguaauaggaguaggagaaaagaaaauaacacaucacuggcacagaucagguucaacaauuggaaaggcauuugaagcuacuguuagaggagcaaaacgaauggcaguauugggugacacggcaugggauuuuggaucaguaggaggagcuuugaauucucuaggcaaaggaauacaccaaauauucggagcagccuucaaaucucuauuuggagguaugagcugguucucacaaauauuaauagguacuuuauuaaugugguuaggauuaaacacuaaaaauggaucaauaucccuaauguguuuagcguuaggagguguauuaauauuccuaaguacagcugucagcgccgau

SEQ ID NO: 2535 - RNA, 2088 nt, Artificial Sequence
  ZIKV prME variant CDS opt
gaaaaaaaaagacgaggggcggauacaucaguaggaauaguugguuuauuauuaacaaccgcaauggcagcagaaguaacuagaagaggaucagcauauuauauguauuuagauagaaaugaugcaggagaggcaauaucauuuccuacaacacuuggaaugaauaaauguuacauacagauuauggauuugggacacaugugugacgcaacaaugaguuacgaaugcccaaugcuagaugaagggguagaaccagacgacguggauuguugguguaacacaaccucaacgugggucguauacggaacaugccaccauaaaaaaggagaagcccgacggagucgaagagcagugacauuaccaagucauucaacgagaaaauuacaaacuagaagccaaacaugguuagaaagccgagaauacacaaaacaucuuauucgaguagaaaauuggauauuuagaaaucccggguuugcacuagcagcagcagcaauagcaugguuacuaggaucaucaacaucccaaaaagugaucuacuuaguaaugauauugcuuauagcgccagcauauaguauaagguguaucggaguaaguaauagagauuucguagaagguaugaguggaggaacauggguugacauaguuuuggagcauggcgggugcguaacaguaauggcacaagacaaacccacgguagacauagaauuagugacuacuacuguaucaaauauggcagaaguuagaagcuacuguuacgaagcaucaauaucugacauggcaagugauaguagauguccaacccaaggagaagcauaucuagauaaacaaucagauacacaauacguauguaaaagaacucuuguagaucgagguuggggaaaugguugcggcuuauuuggaaaaggaaguuuaguaacaugugcaaaauuugcauguucuaaaaaaaugaccgguaaaucgauacagccggaaaaccuagaauaccgaauuauguuaaguguacaugguucgcagcauucaggaaugauagugaacgacacaggucaugaaacagaugaaaaucgugcuaagguagaaauuacaccaaacucgccaagagcagaagcaacacuaggaggauuugguucacugggauuggauugugaaccuagaacaggccuugauuucucagauuuauauuauuuaacaaugaauaauaaacauuggcuuguacauaaagaaugguuucaugauauaccauuaccauggcacgcuggagcagacacggguacaccacauuggaacaacaaagaagcacuaguagaauuuaaggacgcccaugcaaaaagacaaacugugguaguacuagguagucaagaaggagcuguacauacugcucuggcaggggcauuagaagcugaaauggauggugcaaaaggaagauuaucaaguggacacuuaaaaugcagacuaaaaauggacaaauuaagauuaaaaggaguuucauauaguuuauguacagcagcauuuacuuuuacaaaaauuccagcagaaacauuacauggcacaguaacuguagaaguccaauaugcaggaacagacggaccuuguaaaguuccagcacaaauggcaguagacaugcaaacguuaacaccaguuggaagacuuauaacugcaaauccaguaauaacagaaaguacagagaauaguaaaaugaugcuagaauuagauccaccuuucggagauucauauauuguaauagguguaggagaaaaaaaaauaacacaccacuggcaucgaagugguaguacuauaggaaaagcauuugaagcuacagucaggggagcaaagagaauggccguacuaggagauacagcaugggacuucggaagcguuggaggugcccuaaauucauuagggaaagguauacaccaaauauucggcgccgcauuuaaaagccuauuuggaggaaugaguugguuuucacaaauacuaauaggcacauuauuaaugugguuaggcuuaaacacaaaaaauggaucaauaagucuaauguguuuagcauuaggaggaguauuaauuuuucuaucaacagcuguaucugcugac

SEQ ID NO: 2536 - RNA, 2085 nt, Artificial Sequence
  ZIKV prME variant CDS opt
aaaaaaagaagaggagcagacacaaguguaggaauaguaggacuauuauuaacaacugcaauggcagcagaaguaacaagaagaggaucagcguauuauauguaucucgauagaaaugaugcaggagaggcaauauccuucccaacaacucuuggaaugaacaaaugcuauauacaaauuauggauuuaggacauaugugcgaugcaaccauguccuacgaauguccaauguuagaugaagguguagaaccugaugauguagauuguugguguaauacaacaaguacuugggugguauauggaacaugccaucauaaaaaaggagaggcaagaagaagcaggagagcgguaacacuaccaucccauagcacacgaaaacuacaaacuagaagucaaacauggcuagaaagcagagaauacacuaaacaucuuauaagaguagaaaauuggauauuuagaaacccaggguuugcgcuagcagccgcagccauugcuugguuauuaggcucaucaacaagccaaaaaguaauauaccuaguaaugauacuacuaauagcgccugcauauucaauuagaugcauuggagucuccaauagagauuuuguagaaggaaugaguggagggacaugggucgacauaguacuagaacacggagguuguguuacagugauggcgcaagauaaaccaaccgucgauauagaauuaguaacuacaacaguaucaaauauggcagaaguaagauccuauuguuaugaagcaucgauaagcgauauggccucagauucuagaugucccacacaaggagaagcuuacuuagauaaacaaucugauacacaauaugucuguaaaagaacacucguagauagaggauggggaaauggauguggccuauucggaaaagguaguuuaguaacaugugcaaaauuugcauguagcaaaaaaaugacaggaaaaagcauucaaccagaaaaucuggaauauagaauaauguuaucuguacauggaagucaacauucagggaugauaguuaaugauacaggacacgaaacagaugaaaaucgagcaaaaguugaaauaacaccuaauaguccaagagcagaagcaacauuaggaggauuuggaagucuaggauuagacugugaaccuagaacuggauuggauuuuagugacuuauauuaucuuacuaugaauaauaaacacuggcuuguucauaaagaaugguuccacgauauaccacuaccauggcaugcaggcgcugacacagguacaccccauuggaauaacaaagaagcacuaguagaauucaaagaugcucaugcaaaaagacaaacagucguaguucuaggaagucaagaaggagcaguacacacagcuuuagcuggagcauuagaagcagaaauggauggugcaaaaggacgacuaucaucaggacacuuaaaaugcagacuaaaaauggauaaauuaagacuaaaaggaguaucauauaguuuguguacagccgcauuuaccuuuacaaaaauuccagcugaaacauuacacggaacuguaacaguggaaguacaauaugcagguacagacggaccguguaagguaccagcucagauggcaguagauaugcaaacauuaacgcccguugguagauuaauaacugcaaauccagugauaacagaaucaacagagaauagcaaaaugaugcuagaauuagaucccccauuuggagauagcuauauaguaauuggaguaggagaaaaaaaaauaacacaucauuggcaucgaucaggauccacuauagguaaagcuuuugaagcaacaguaagaggggcuaaaagaauggcgguauuaggagauacagccugggauuuuggaucagucggaggugcauuaaacaguuuagguaaaggaauucaucaaauauuuggagcagcauucaaaagcuuauuuggagguaugucaugguuuucgcaaauacugauuggaacauugcuaauguggcuaggacuaaauacuaaaaauggaaguaucucauuaaugugucuagcacuaggagguguauuaauauuucucagcacagcagucucagcagau

SEQ ID NO: 2537 - RNA, 2082 nt, Artificial Sequence
  ZIKV prME variant CDS opt
aaaagaagaggugcagauacaucaguaggaauaguuggguuauuacuaacaacagcaauggcagcagaaguaacgagaagggguagugcguacuauauguaccuagaccgaaaugaugcaggugaagcuauaagcuuuccaaccacacuaggcaugaauaaauguuauauacaaauaauggaucuaggacauaugugugaugcuacaaugaguuacgaauguccaaugcuagacgaaggaguagagccagacgauguagacuguugguguaauacgacaucaacauggguaguauaugguacaugucaucacaaaaaaggcgaagcaagacgaucaaggagagccgucacucuaccaagucacagcacaagaaaacuacaaacuagaagucaaacaugguuagaaucaagagaauauacaaaacaucuaauaaggguggaaaacuggauauucagaaauccagguuuugcacuagcagcagcagcgauagcuugguuauuagguaguucuacuucacaaaaaguuauauacuugguaaugauuuuauuaauagcacccgcauacaguauaaggugcauuggaguaaguaauagagauuuuguagagggaaugaguggaggaacauggguagauauaguauuagaacauggaggcuguguaacugugauggcacaagacaaaccuacaguagacauugaauuaguaacgacaacaguuucaaauauggcagaaguaagaucuuauuguuaugaagcaaguauaagcgauauggcaagugacagcagauguccaacacaaggggaagcuuaucuugacaagcaaucagacacgcaauacguuuguaaacggacauuaguagauaggggcugggggaacggauguggauuauuuggaaaaggguccuuaguaacaugcgcaaaauucgccuguaguaaaaaaaugacaggaaaaucuauacaaccagaaaaucucgaauauagaauaauguuaucaguacauggaagucaacauucagggaugauaguaaaugauacuggccaugaaacagacgaaaauagagcaaaaguagaaauaacaccuaauagucccagagcagaagcaacauuaggaggauucggaucauuaggauuagacugugaaccaagaacaggccuagauuucucugacuuauauuaccuaacaaugaauaauaaacacuggcuaguucacaaagagugguuucaugacauaccgcuaccuuggcaugcaggugcagauacaggaacgccacauuggaauaauaaagaagcacuaguagaguuuaaagaugcucaugcaaaaagacaaacgguaguaguauuaggaagccaagaaggagcaguacacacagcucuagcaggagcucuugaagcagaaauggauggugcuaaaggucgauuaucauccggacacuuaaaauguagauuaaaaauggacaaacuaagauuaaaaggaguaagcuacagccuauguacagcagcauuuacauuuacaaaaauaccagcagaaacuuuacauggaacaguaacaguugaaguacaauaugcaggaacagaugggccauguaaaguuccugcgcaaauggcaguagacaugcaaacauuaacaccaguaggaagauugauaacagcaaauccaguaauaacugaaucaacugaaaacucaaaaaugaugcuagaacuagacccaccauucggagauagcuauauaguaauuggaguuggcgaaaaaaaaauaacacaucauuggcacagaaguggaaguacgauuggaaaagcauuugaggcaacaguaagaggugcuaaaagaauggcaguacuuggagacacagcuugggauuuugguagcguaggaggagcauuaaauucacuuggaaaaggaauucaucaaauauucggagcagccuucaaaucacuauuuggaggaaugaguugguuuucacagauauuaauugggacacuucuaauguggcuaggauugaauacaaaaaaugggaguauaucuuuaaugugucuagcauuaggggguguauuaauauucuugucaacagcugugucugccgau

SEQ ID NO: 2538 - RNA, 2079 nt, Artificial Sequence
  ZIKV prME variant CDS opt
agaagaggcgcagauacaucagucggaauuguuggucuuuuguuaacuacagcaauggcagcagaaguaacaagacguggaagugcguacuacauguaccuagacagaaaugaugcaggagaagcaaucucauuuccuacuacucuggguaugaacaaaugcuauauacaaauaauggaucuaggccauaugugugaugcgacaaugucauaugaguguccaaugcuagacgaagguguugaaccugacgauguagauugcugguguaacacaacaucaacauggguaguauauggaacaugccaccauaagaaaggagaagcuagaagaucaagacgagcaguaacauuacccagucauaguacaagaaaauuacagacaagaagccaaacauggcuagaaucgagagaauauacuaaacaucuaauaagaguagaaaauuggauauuccgaaacccaggauuugccuuggcagcagcugccaucgcauggcuuuuaggaaguucgacaagccaaaaaguaauauaucuaguuaugauacuucucauagcaccagcuuauucaauaagauguaucgguguuaguaacagagauuuuguagaagguauguccggagguacuuggguugauauaguauuagaacaugguggauguguuacuguaauggcacaagauaaaccaacaguagauauagaauuaguaacaacuacaguaagcaacauggcagaaguaagaucuuauuguuaugaagcaucaauaucagauauggcaagugauaguagaugcccaacccaaggagaagcauacuuagauaaacagucagauacacaauauguauguaaacgaacuuuaguugaucgaggguggggaaacggaugugguuuauuuggaaaaggaaguuuaguaacaugugcuaaauuugcaugcucaaagaaaaugacaggaaaaucaauacaaccagaaaauuuagaauauaggauaaugcuuagcguacauggaucacaacauuccggaaugauuguaaaugacacgggacaugaaacugaugaaaacagagcuaaagucgaaauaacaccuaauaguccucgagcagaagcaacauuaggaggauuugguagcuuaggacuugacugugaaccuagaacaggacuagauuuuagugaucuauacuaccuuaccaugaauaauaaacauuggcuaguacacaaagaaugguuucaugacauaccauuaccauggcaugccggagcagacacagguacaccucacuggaauaauaaagaagcccuaguagaauuuaaagaugcacacgcaaaacgacaaacagugguggucuuaggaagccaagaaggagcaguacauacagcauuagccggugcucuagaagcagaaauggauggugcaaaaggaagacuuagcucaggacauuuaaaauguagguuaaaaauggauaaauuaagguuaaaaggaguaucauauagucuaugcacagcagcauuuacuuucacaaaaauacccgccgaaacgcuacacggaacaguaacaguagaaguacaauacgcaggaacugaugguccauguaaaguaccagcucaaauggcaguagacaugcaaacauuaacaccaguagguagguuaauaaccgcgaauccaguaauaacugaaucaacagaaaauagcaaaaugauguuagaacuagacccuccauucggagauagcuauauaguaauagguguaggagagaagaaaaucacacaucauuggcauagaaguggaucaacaauaggaaaagcauuugaagcuacaguaagaggagcaaaacguauggcaguauugggagauacugcaugggauuuuggaaguguagggggagcucuaaauucacuuggcaaaggaauacaucaaauauuuggagcagcauuuaaauccuuauucggaggaaugucuugguuuagccaaauacuaauaggaacuuuauuaauguggcuuggacuaaacacuaaaaauggaucaauuucuuuaaugugucuagcucuaggaggaguacuuaucuuucuaaguacagcagugagugcagac

SEQ ID NO: 2539 - RNA, 2076 nt, Artificial Sequence
  ZIKV prME variant CDS opt
agaggagcagacacaaguguagguauaguuggauuauuauuaacaacagcaauggcagccgaaguaacaagaagagguucagcuuauuauauguauuuagacagaaaugaugcaggagaagcaauaucauucccaaccacgcuuggaaugaauaaaugcuauauacaaauaauggauuuaggacacaugugugaugcaacaaugucauaugaaugccccauguuagaugaagguguagaaccagaugacguagacuguugguguaauacaacgagcacaugggucguauauggaacuugccaucauaagaaaggagaagcuagacgaagcagacgagcaguaacgcuaccaagucacucaaccagaaaauugcaaacaaggagucaaacauggcuagaaucaagagaauauacuaaacaucuuaucagaguagaaaauuggauuuuucgaaauccaggauuugcacuugcugcagcugcuauagcauggcuauuagguucaagcaccucacaaaaaguaauauaucuaguuaugauacuauuaauugccccugcauacucaauuagauguauaggaguaucaaauagagacuucguagagggaaugucaggaggaacuuggguagauauaguacuagaacaugguggauguguaacaguaauggcacaagauaaaccaacuguugacauagaauuaguaacaacaaccguaaguaauauggcagaaguaagauccuacugcuaugaggcaaguauaagcgauauggcaucagauagucgauguccaacacaaggggaagcauauuuagauaaacaaucagauacgcaauacgucuguaaaagaacauuaguggacagaggaugggguaaugguuguggacuauucggaaaagguagcuuaguuacaugugcaaaauuugcauguaguaagaaaaugacaggaaaaucaauucaacccgaaaacuuagaauauagaauaaugcuaucaguacauggaagucaacauucagguaugauuguaaacgauaccggccaugaaaccgaugaaaauagagcuaaaguagaaauaacgccuaauagcccaagagcggaagcaacacugggaggauuugggagcuuaggauuggauugugaaccaagaacaggacuagauuucucugacuuauauuaccuaaccaugaauaauaaacauugguuaguacauaaagaaugguuucaugauauaccacuaccguggcaugcaggggcagauaccggaaccccacacuggaauaauaaagaagccuuaguagaauuuaaagacgcgcaugcaaaaagacaaacuguaguaguauuaggaucacaagaaggggcaguucacaccgccuuagcaggagcacuagaagcagaaauggauggagcuaaaggucgacuaucaucaggacauuuaaaauguagacuuaaaauggauaaauuaagauuaaaaggaguuaguuacucauuaugcacugcagcauucacuuucaccaaaauaccagcagaaacauuacauggcacuguaacaguagagguacaauaugccggaacagauggacccugcaaaguaccagcgcagauggcugucgauaugcaaacauuaacuccaguuggucgacucauaacugcuaaucccguaauaacagaaucaacagaaaauucaaaaaugaugcuugaauuagauccucccuuuggagauucauauauaguaauaggaguaggggaaaagaaaauaacccaccauuggcauagaaguggaaguacaauugguaaagcauuugaagcaacaguuagaggagcaaaaagaauggcgguauuaggagauacagcgugggacuucggcagcguaggaggcgccuuaaauucuuuaggaaaagggauacaucaaauauuuggagcagcauucaaaucauuauucggaggaaugucaugguuuucacaaaucuuaauaggaacucuauuaaugugguuaggucuaaauacuaaaaacggcucaauaaguuuaauguguuuggcacuaggcggaguacuaauuuuccuaucgacagcaguauccgcagac

SEQ ID NO: 2540 - RNA, 2073 nt, Artificial Sequence
  ZIKV prME variant CDS opt
ggagcggauacaucaguugguauaguaggacuguuauuaacaacagcuauggcugcagaaguaaccagaagaggaucagcauauuauauguauuuagauagaaaugaugcuggagaagcuauaucauuucccaccaccuuaggaaugaauaaauguuacauucaaauaauggauuugggacacaugugcgaugcaacaaugagcuaugagugucccauguuagacgaaggaguugaaccagaugacguagauuguugguguaauacgacaaguacuuggguaguauacggcacaugucaucacaagaaaggagaagcacgccgcucaagacgagcuguaacccuucccagucauaguacaaggaaauugcaaacucguagccaaacaugguuagaauccagagaauauaccaaacaucucauaagaguagaaaacuggauauuuagaaauccaggauucgcauuagcugcagcagcaauagcauggcuccuaggaucaagcacaucccaaaaaguuauauaccuaguuaugauauuauuaauagcuccagcauauucaauuagauguauaggaguuucaaaccgugacuuuguugaaggcaugucaggaggaacauggguagauauaguacuagaacacggaggauguguaacuguaauggcacaagacaaacccacaguugauauagagcuaguuacuacaacaguaaguaauauggcagaaguaagaaguuauugcuacgaagcaucaauaagugauauggcaagugacaguagaugcccaacccaaggagaagcguacuuagacaaacaaagugauacccaauauguuuguaaaagaacacuuguugaucgaggauggggaaauggaugcggacucuuugguaaaggaucauuaguaacaugugcaaaauuugccuguagcaagaaaaugacaggaaaaucaauacaaccagaaaaccuagaauauagaauaauguuaucuguacaugguucacaacauucagguaugauugucaacgacacaggacaugaaacugaugaaaauagagcaaaagucgaaauaacuccaaauucaccacgagcagaagccacuuuaggggguuuuggaagucuaggauuagacugugaaccaaggacaggauuagauuuuucagaucuauauuauuuaacaaugaacaacaaacauuggcuaguacacaaagaaugguuucaugacauaccauuacccuggcacgcaggcgcugacacuggaacuccgcacuggaauaauaaagaagcccuaguugaguucaaagacgcacaugcaaaaagacaaacaguaguuguauuaggaucacaagaaggagcuguacauacagcauuggccggagcauuagaagcugaaauggauggagcaaaagguagacuaagcagcggccaucucaaaugcagauuaaaaauggacaaacuaagacuaaaaggcguuucauacucacuauguacagcagcuuuuacauuuacuaaaauaccugcagaaacauuacaugguacaguaacaguugaaguacaauaugcaggaacagauggaccaugcaaaguaccagcacaaauggcagucgauaugcagacauuaacgccaguaggacgacuaauaacagcaaauccuguaauaacagaaagcacagaaaauucaaaaaugaugcuagaacucgacccucccuucggggauucauauauaguaauaggaguaggcgaaaagaaaauaacacaccauuggcaucguucaggaaguacuauaggaaaagcauucgaagccacaguaagaggugcaaaaaggauggcaguguuaggagauacagcaugggauuuuggaucagucggaggagcacuaaauagcuuaggaaaaggaauacaucagauauuuggagcagcauuuaaaaguuuauucgguggaaugucuugguucucucaaauuuuaauaggaaccuuacuuaugugguuggggcuaaauaccaaaaauggaucaauaucauuaaugugcuuagcucuaggagguguacuaauauuucuaucgacagcaguguccgcagau

SEQ ID NO: 2541 - RNA, 2070 nt, Artificial Sequence
  ZIKV prME variant CDS opt
gcugauacaucaguaggcauaguaggucuacuuuuaacaacagcaauggcagcugaaguaacaaggcgagguagcgcuuauuacauguacuuagauagaaaugaugcaggggaagcuauaucuuuuccgacaacauuaggaaugaauaaaugcuauauucaaauaauggaccugggacauaugugugaugcgacaaugaguuaugaaugcccaauguuagaugaaggaguugaaccggaugacguagacugcugguguaauacaacaaguacaugggucguauaugguacaugucaucauaaaaaaggagaagcaagaagaucaagaagagcaguuacauuaccuucacacucuacaagaaaauugcaaacacgaagccaaacguggcuugaaucaagagaguacacaaaacauuuaauccgaguagaaaauuggauuuucagaaauccaggauucgcacuagccgcagcagcaauagcaugguuacucggaucaaguacaucacaaaaaguaauuuacuuaguaaugauauuacuaauagccccagcauauaguauaagauguauaggaguaaguaauagagauuuuguggaaggaaugaguggagguacguggguagauauuguauuagaacaugguggauguguaacaguaauggcacaggauaaaccaacaguagacauugaauuaguaacaacaaccguaucaaacauggcagaaguaagaucauacuguuaugaagcaaguauaucugauauggcgagcgacucaagauguccuacacaaggugaagcguaucuagauaaacaauccgauacucaauauguauguaaaagaacccuaguagacagaggguggggcaaugguugugguuuauuuggcaaaggaucauugguaacaugugcaaaauucgcaugcucaaaaaaaaugacuggaaaaucaauucagccggaaaaccuagaauauagaauaauguuaucuguucacggaagucaacacucaggaaugauuguaaacgauacuggucacgaaacugaugaaaauagagcuaaaguagaaauaacaccaaauaguccaagagcagaagccacccuugguggauucggaagucuaggauuagauugcgaaccaaggaccggauuagacuucucagauuuauauuaucuaacuaugaauaauaaacauuggcuaguacacaaagaaugguuucacgauauaccuuuaccauggcaugcaggagcagauaccgguacaccacacuggaacaauaaagaagcuuuaguagaauuuaaagaugcucacgcaaaacgacaaacgguuguaguacuaggaucacaagaaggagcaguccacacagcauuagcgggagccuuagaagcagaaauggauggagcaaaaggaagacuuaguucaggacauuuaaaaugccgauuaaaaauggauaagcuuagacuaaaaggaguaaguuacagccugugcacagcugcauuuacauuuacaaaaaucccagcggaaacauuacauggaaccgucacaguagaaguacaauacgccggaacagauggcccaugcaaaguaccagcucaaauggcuguagauaugcaaacacuaacaccaguaggaagacuaauaacagccaacccaguaauaaccgagucuacagaaaacaguaaaaugauguuagaacucgauccuccauuuggagauagcuauauaguaauugguguaggagaaaaaaaaauaacacaucauuggcaucgaucagguucaacaauagguaaagcauuugaagcuacaguacgaggagccaaaagaauggcaguauugggugauacagcaugggauuuuggaucugucggaggagcauuaaacucauuaggaaaagguauacaucaaauauuuggugcugcauucaaaagcuuauuuggaggaaugucaugguuuucccaaauucuaauaggaacauuauuaaugugguuaggauuaaacacgaaaaaugggucaauaagucuaaugugccuugcauuagguggaguacuaauauuucuaagcacugcaguaucagcugau

SEQ ID NO: 2542 - RNA, 2067 nt, Artificial Sequence
  ZIKV prME variant CDS opt
gacacaaguguaggaauaguaggauuguuauuaacaacugcaauggcagcagaagucacucgucgugguagcgcauacuauauguauuuagauagaaaugaugcaggagaagcaauaucuuuuccgacaacauuaggaaugaacaaauguuauauacaaauaauggauuuaggucauaugugugacgcuacgaugucauaugaauguccaauguuggaugaaggaguagaaccagaugacgucgauuguuggugcaauacgacauccacauggguaguuuaugggacaugucaucauaagaaaggagaagcgaggagaagcaggagagcaguaaccuuaccaagucacagcacaagaaaacuacaaacaagaagucaaacaugguuagaaucaagagaauauaccaaacacuuaauaaggguggaaaauuggauauuucgaaauccaggauuugcauuagcagcagcugcaaucgcgugguuauuaggaucaucaacaucacagaaaguaauauaccuaguuaugauauuauuaauagcaccagcauauagcauaagaugcauaggagugaguaauagagauuuuguagaaggaaugaguggaggcaccuggguagauauaguacuagaacauggcggaugugucaccguuauggcucaagauaaaccaacaguagauauagaauuaguaacuacaacaguaucaaauauggcagaaguaagaaguuacugcuaugaggcuucaauaagugacauggcuucagauucaagauguccgacacaaggagaagcauauuuagauaaacagucugauacucaauauguaugcaaaagaacccuaguagacagaggauggggaaaugguugugguuuauucggaaaaggaagucugguuacaugugcaaaauucgcaugcucuaagaaaaugacaggaaaaucaauccaaccagaaaaccuagaauacagaauaauguuaucaguacacggcucacaacauaguggaaugauagugaaugauacuggacacgaaacugaugaaaaucgagcaaaaguagaaauaacacccaacaguccgagagcagaagcuacauuaggaggauuugguucauuaggauuggauugcgaaccaagaacagguuuagacuuuagugauuuauauuaucuuaccaugaauaacaaacauuggcuuguacauaaagaaugguuucaugacauuccucuaccauggcaugccggagcagauacggguacuccacacuggaauaauaaagaagcauugguagaauuuaaagaugcacaugcaaaaagacaaacuguaguaguauuaggaagucaagaaggagcaguucauacugcguuagcuggagcauuagaagccgaaauggauggagcaaagggaagauuaucaaguggacaccuuaaaugccgacugaaaauggauaaacuaagacuuaaagguguuucuuauucuuuauguacugcggcuuucacauuuacgaaaauacccgcugaaacacuucaugguacuguaacaguagaaguacaauaugcaggaacagacggaccauguaaaguaccagcacaaauggcagucgauaugcaaacacuuacaccaguagguagacuuaucacagcgaauccaguuauaacugaaaguacagaaaauaguaaaaugaugcuggaauuagauccuccuuucggagacaguuacauaguuauugguguaggggaaaagaaaauaacacaucacuggcauagaaguggaucaacuauaggaaaagcauuugaagcaacaguccguggagcaaaacgaauggcaguacuaggcgauacugcaugggauuuugguagcguugguggagcacuaaauucacuuggaaaaggaauacaccaaauauuuggagcagcauuuaaaucacuuuuugguggcaugucaugguuuucacaaauuuuaauuggaacauuauuaauguggcuaggauuaaauacuaaaaacgguaguauaucguuaaugugucuagcacuagguggagucuuaauauuucuuaguacagcaguuagugcagau

SEQ ID NO: 2543 - RNA, 2064 nt, Artificial Sequence
  ZIKV prME variant CDS opt
acaagugucggaauaguaggauuauuguuaacaacggcaauggccgcagaagugacgagaagggggucugcuuauuauauguaucuugauagaaaugaugcaggagaagcuauaaguuuuccaacaacucuaggaaugaauaaauguuacauucagauaauggacuuagggcauaugugcgaugcaacaaugucauacgagugcccaaugcuagaugaaggaguagaaccagaugacguugacugcugguguaauacaacuucaacauggguagucuacgguacaugucaucacaaaaaaggagaagcaagaagaucuagaagggcagugacauuaccuagucauagcacgaggaaacuccaaacccgaucacaaacauggcuagaaagcagagaauauacaaagcaccuaauaagaguagaaaauuggauuuuuagaaauccaggauucgcauuagcagccgcugcgauugcaugguuacuuggaucaaguacgucgcaaaaaguuauauacuuaguaaugauauugcuaaucgcaccagcauauucgaucagaugcauaggaguaucaaacagagacuucguagaaggaaugaguggaggaacauggguagauauaguacuagaacauggagguugugugacaguaauggcacaagauaaaccaacuguggacauagaacuagugacaacaacaguaucaaacauggcagaaguacgaucuuacuguuaugaagcgucaauaagcgauauggcaagcgauaguagaugcccaacacaaggagaagcauacuuagauaaacaaucagauacucaauauguauguaaacgaacacuaguagauagaggauggggaaauggauguggauuauuuggcaaaggaagucugguaacuugugcaaaauuugcuugcaguaaaaaaaugacaggaaaaaguauacaaccagaaaaccuugaauauaggauuauguuaaguguucacgggagucaacauagugggaugauugucaaugauacaggacaugaaacagacgaaaauagagcaaaagucgaaauaacgccaaacaguccaagagcugaagcgacauuaggaggauuuggaucauuaggacuagauugugaaccaagaacugggcuagacuuuucagacuuauacuaucuaacaaugaauaauaagcacugguuaguucauaaagaaugguuucaugacauaccacuaccuuggcaugcaggagcagauacuggaacuccgcauuggaauaauaaagaagcauuaguagaauucaaagaugcacaugcaaaacgacagacaguagucguacuuggaagucaagaaggagcggugcauacagccuuagcaggagcauuagaagcagagauggacggcgcuaaagguagacuuagcagcggacaucuaaaauguagacuaaaaauggauaaacuaagacuaaaaggaguaucauauucauuauguaccgcagcguucacauuuacaaaaauaccagcggaaacauuacauggaacuguaacaguagaaguacaauaugcaggaacugauggaccauguaaaguaccagcacaaauggcaguagauaugcaaacauuaacacccguaggaagacuaauaacagcaaauccaguaauaacagaaaguacagaaaauucuaaaaugauguuggaauuagacccaccuuuuggagacaguuacauaguaauaggaguaggagaaaaaaaaauaacacaccauuggcauaggaguggaagcaccauaggaaaagcauuugaagcuacuguaagaggagcgaaacgaauggcuguucuaggagauacggcuugggacuuuggaaguguaggaggagcguuaaauagucucggcaaaggaauucaucaaauauucggagcagcauuuaaaucacuauuugguggaaugucaugguuuagucaaauauugauaggaacacuauuaaugugguuaggauuaaauacuaaaaacggcaguauaucacuaaugugcuuagcauuagguggaguuuuaauauuccuaaguacagcaguaagugcagau

SEQ ID NO: 2544 - RNA, 2064 nt, Artificial Sequence
  ZIKV prME variant CDS opt
acaucaguaggaauuguugguuuacuauuaacaacagcaauggcagccgcaguaacacgccgaggcucggcuuacuauauguauuuagauagaaacgaugcaggagaagcaauaucauuuccaaccacacuggguaugaauaaaugcuauauccaaauaauggaucuaggacauaugugcgacgcaacaaugucauaugaauguccaaugcuagaugaaggagucgaaccagaugauguagauugcugguguaauaccacaaguaccuggguaguauauggcacaugucaucauaagaaaggcgaagcaagaagaaguagacgagcaguaacauuaccaucacauucaacaagaaaacuucaaacaagaagccaaacuuggcuagaaagcagagaauauacaaaacauuuaauaagaguggaaaauuggauauucagaaauccuggcuuugcauuagcugcagcggcuauagcuugguuacuuggaucuaguacuucacagaaaguaauauaucuaguaaugauacuauuaauagcaccagcuuacaguauccgaugcauaggaguaucgaacagagauuuuguagaagggaugucagguggaacauggguagauauaguauuagaacacggcggaugcguaacaguaauggcacaagacaaaccaacaguagacauagaacuuguaacaacaacaguaucaaauauggcagaaguuagaucauacugcuaugaagcaucaauaucagacauggcuucagauaguagauguccaacacaaggagaagccuacuuagauaaacaguccgauacucaauauguauguaaaagaacccuaguagaccgcgguuggggaaaugguugcggacuauucggaaaaggaagucuaguaaccugugcaaaauuugcauguaguaagaaaaugaccggaaaaaguauucaaccagaaaauuuagaauauagaauaauguuaaguguacauggcucucaacauucaggaaugauagucaaugauacaggucaugaaacagaugaaaauagagcuaaagucgaaauaacaccaaauucaccacgugcugaagcaacacuaggaggauuuggaucacucggauuagauugugaaccaaggacaggcuuggauuucucagauuuauauuaucuaacuaugaacaacaaacauugguuaguccauaaagaaugguuucacgauauaccucuaccauggcaugcuggugcagauacaggaacaccccauuggaauaauaaagaagcucuagucgaauuuaaagaugcacacgcaaaacgccagacaguaguuguacuaggaagccaagaaggagcaguacacacagcucuagcaggagcuuuagaagcagaaauggauggugcaaaaggaagacuaagcucaggacaucugaaaugcaggcuaaaaauggauaaauuaagauuaaaaggaguaagcuauucauuauguacagcagcauuuacauucacaaagauaccagcggaaacauuacacgggaccguaaccguagaaguacaauaugcagguacagacggaccauguaaaguaccagcacaaauggcaguagacaugcaaaccuuaacaccaguaggucgauuaauaacagccaauccaguaauaacagaaucaaccgaaaauuccaaaaugaugcuagaauuagauccaccuuucggagauaguuauauaguaauaggaguaggagaaaagaaaaucacacaucacuggcauagaucuggcuccacuauaggaaaagcauuugaagcuaccguuagaggagcaaaaagaauggcugucuuaggagauacugcaugggacuuuggaaguguuggaggugcacuuaacagccuaggaaaaggaauacaucaaauauucggugcagcuuuuaaaagucucuucgguggaauguccugguucucucaaauuuuaauagguacacuacuuauguggcuuggucuaaacaccaaaaauggaucaauaucauuaaugugccuggcacuaggaggaguacuaauauucuuaucaacagcuguaagcgcagau

SEQ ID NO: 2545 - RNA, 2076 nt, Artificial Sequence
  ZIKV prME variant CDS opt
agaggagcagauacaaguguugguauaguaggcuuacuauuaacaacagcaauggccgcugcuguaacacgaagaggaagugcauauuacauguacuuagaccgaaacgaugcaggagaagccauaucauuuccaacaacguuaggaaugaacaaaugcuacauacagauaauggaucuaggacauaugugugacgcaacgaugucauacgaauguccaauguuagaugaaggcguagaaccagaugauguagauuguuggugcaacacaacaaguacauggguaguauauggcacaugucaccauaaaaaaggggaagccagaagaagcagaagagcgguaacacuaccuucacauaguacuagaaaacuucaaacgcgcucucaaacauggcuugagaguagagaguauacaaaacauuuaauuagaguagaaaauuggauauuucgaaaucccgguuuugcauuagcagcagcagcaauagcauggcugcucggaucaucaacuucacaaaaaguuauauauuuaguaaugauauuacuaauagcaccagcauacagcauacgaugcauaggaguuucaaacagagauuuuguagaaggaaugucuggaggaaccuggguagacauugugcuugagcauggaggaugcguaacuguuauggcacaggacaaaccaacgguugauaucgaauuaguuacaacuacaguaucaaauauggcggagguuagauccuauuguuaugaggcaucuauaucagauauggcaucagauucgagauguccuacucaaggugaagcuuaucuagacaaacaaagugacacgcaauauguuuguaaaagaacuuuaguugacagaggauggggaaauggcugugguuuauuuggaaaagggaguuuaguaacaugugcaaaauuugccuguucuaaaaaaaugacaggcaaaucaauacaaccagaaaauuuagaauauagaauaauguuaucaguacauggaagucaacauagcggaaugauaguuaaugauacaggacacgaaaccgaugaaaaccgugcuaaaguugaaauaacaccaaauucaccaagagcagaagcaacauuaggaggauucggauccuuaggacuugacugugaaccaagaacaggacuagacuuuagugacuuauauuauuugacaaugaauaauaaacauugguuaguacauaaagaaugguuucacgauauaccauuaccuuggcacgcaggagcagauacaggcacaccacauuggaauaacaaagaagcuuuaguagaauucaaagacgcacacgcaaaacgacaaacuguugucguacuaggaucacaagagggugcaguacacacagcgcuagcuggagcauuagaagcagaaauggacggagcuaaaggacgcuuaucaucagggcaccuaaaaugucgacuaaaaauggauaaacuaagguuaaaaggaguauccuauucccuauguacagcagcauucacauucacaaaaauaccagcagaaacauuacacggaacaguuacuguggaaguacaauaugcaggaacagauggaccauguaaaguuccagcucaaauggccguagacaugcaaacguuaacaccaguaggaagacuuauuacagcgaacccaguuauaacagaaaguacugaaaauaguaaaaugauguuggaauuagauccuccauuuggagauucuuauauaguaaucggcguaggggaaaaaaagauaacacaucauuggcacagaagcggaucuacaaucggaaaagcauuugaagcaacaguaagaggcgcaaaaagaauggcaguacuaggagauaccgcaugggauuuugguaguguaggaggagcacuaaauagccuaggaaaaggaauacaccaaauauucggggcagcauucaaaagcuuauuugguggaaugucaugguucagccaaauacuaauaggaacauuauuaauguggcuuggacucaacaccaaaaauggaucuauuagccuaaugugcuuagcguuaggaggaguacuaauauucuuaucaacagcaguaagugcagau

SEQ ID NO: 2546 - RNA, 2100 nt, Artificial Sequence
  ZIKV prME variant CDS opt
cgaggauuaucaucaaggaaacgaagaagccaugacgucuuaacuguacaauucuuaauacuaggaaugcuauuaaugacaggcgguguaacaagaagaggaagugcauacuacauguaucuugacagaaacgaugcgggugaagccauaagcuuuccaacaaccuuaggaaugaauaaauguuacauacaaauuauggacuuagggcauaugugcgaugcaacaaugaguuaugaauguccuaugcuagaugagggaguagaaccugacgauguagacuguuggugcaacacaacaucaacuugggucguuuaugggacuugucaccauaaaaaaggugaggcaagaagaaguagaagagcaguaacauuaccuucacauuccacaagaaaauugcaaacacgaucacaaacaugguuagaaaguagagaauacacaaaacaccuuauaagagucgaaaauuggauauuucgaaauccaggcuuugccuuggcugcugcagcaauugccuggcuauuagguaguucuacuagucaaaaagugauauauuuagugaugauuuuauugauagcaccggcauauagcauaagauguauuggcguaaguaauagagauuuuguugaagguaugaguggugguaccuggguagauauaguccuagaacauggaggauguguaacaguaauggcacaagauaaaccaacaguagauaucgaacuaguaacuacaacugucucaaacauggcagagguuagaaguuauuguuacgaagcaaguauaagugauauggcaagcgauucucgauguccaacacaaggugaagcuuacuuagauaaacaaucagauacacaauauguauguaaaagaacacuaguugacagaggaugggguaauggauguggacuauuuggaaaaggauccuuagucacuugcgcuaaauuugccuguagcaaaaaaaugacggguaaaucaauacaacccgaaaauuuagaauaccgaauuauguugaguguucauggaucucaacauucagguaugauuguaaaugauacaggacaugaaacagaugaaaaccgagcaaaaguagaaaucacuccaaacagcccuagagcagaggcaacccuuggaggauucggaaguuuaggccuagauugugaaccaagaacaggauuagauuuuagugacuuauacuaccuaacaaugaauaauaaacauugguuaguacauaaagaaugguuucaugauauacccuuaccuuggcaugcuggagcagacacaggaacgccacauuggaauaacaaagaagcacuaguugaauuuaaagaugcacaugcaaaaagacaaacaguaguaguauuaggaagucaagagggagcagugcacacagcuuuagcaggcgcacuagaagcugaaauggacggugcaaaagguagacuaucaaguggacacuuaaaauguagacuaaaaauggacaaauuaagauuaaaaggggugucauauucuuuauguacagcugcauuuacauucacuaaaauuccagcagaaacacuacauggaacaguaacaguggaaguacaauaugcaggaacagauggaccaugcaaagugccugcacaaauggcaguagauaugcaaaccuuaaccccaguaggaagauuaauaacggcaaacccgguaauaaccgaaucaacugaaaacaguaaaaugauguuggaacuagauccaccauuuggagauucauauauaguuauaggagugggagaaaaaaaaauaacccaucauuggcauagaaguggaagcacaauaggaaaggcauucgaagcuacagucagaggagcaaaaagaauggcuguucuuggagauacagcaugggauuuugguaguguugguggagcuuuaaauagccuuggaaaaggaauucaucaaauauuuggagcagcauucaaaagcuuauuuggaggaaugucuugguuuucacaaauauugauaggaacacuuuuaaugugguuaggauugaacacaaagaacggaaguauaucuuuaauguguuuagcauuaggugguguucuaauuuuucuaucaaccgcaguaagugcagau

SEQ ID NO: 2547 - RNA, 2100 nt, Artificial Sequence
  ZIKV prME variant CDS opt
agaggauugaguaguagaaaacgacgaagucacgauguucuaacaguacaauuucuaauuuuagguaugcuauugaugacaggagcaguaacaagacgaggaucagcauauuauauguauuuagauagaaaugaugcaggagaagcaauaaguuuuccaacuacuuuaggaaugaacaaauguuauauucaaauaauggauuuaggccauaugugugaugcuacaaugaguuaugaaugcccaauguuagacgaaggaguagaaccagacgacguagauuguugguguaauacaacaucaacauggguaguguauggcacaugucaucacaagaaaggagaagcgagaagaaguagacgagcaguuacacuaccaagucauagcacgagaaaauuacaaacaagaucacagaccugguuagaaucaagagaauacacuaaacaccugauaagaguagaaaauuggauuuuuagaaaucccggauuugcacuagcagcugcagcuauagcuuggcuauuagguaguuccacuagccaaaaaguaauuuaccuaguaaugauauuacuaauagcaccagcauauaguauaagaugcauaggagugucaaauagagauuuuguagaaggaaugagcggugguacauggguggauauagucuuagaacauggaggauguguaaccguaauggcacaagacaaaccaacaguugauaucgaacuuguaacaacaacgguaucaaauauggcugaaguaagaucauacuguuaugaagcaaguauaucagauauggcaagugacucaagaugcccaacacaaggagaagcauaucuagauaaacaaucagacacacaauaugugugcaaaagaacauuaguagacagaggauggggaaauggauguggacuauucggaaaagggagcuuaguaacaugcgcuaaauucgcgugcaguaagaaaaugacaggaaaaaguauacaaccagaaaauuuagaauauagaauaaugcuaucaguacacggaucgcaacauucagguaugauaguaaacgauacaggacaugaaacagaugaaaaccgagcuaaaguggaaauaacgccaaauucacccagagccgaagcaacauuaggggguuucggaaguuugggauuggauugcgaaccuagaacgggguuagauuuuucagauuuauauuaccuaacaaugaauaauaaacauuggcucguacacaaagaaugguuucaugauauaccuuuaccauggcaugcaggagccgauacugguacuccacauuggaauaauaaagaagcccuaguagaauuuaaggaugcucacgcaaaaagacaaacaguugugguucuaggaagucaagaaggagcgguacauacagcauuagcaggcgcauuagaagcugaaauggauggagcgaaaggucgacugaguucaggacaucuaaaauguagauuaaagauggauaaacuaagacuaaaaggaguaucauauucauuauguacugcagcuuuuacguuuaccaagauuccagcagaaacacuacauggaacuguuacaguagaaguucaauaugcuggaacagacggaccaugcaaaguacccgcacagauggcuguagacaugcagacauuaaccccaguaggacgacuaauaacggcuaacccagucaucacugaaucaacugaaaauucgaaaaugaugcuagaacuagacccaccuuuuggagacaguuauauaguuauuggaguuggagaaaagaaaauaacacaucacuggcauagaagcggaaguacaauagguaaagcauuugaagcaacaguacgcggugcaaaaagaauggcaguuuuaggagauacugcaugggauuucggaucuguagguggagcacuaaacucucuuggaaaagguauucaucaaauauuuggagccgcuuuuaaaaguuuguuuggaggaaugagcugguuuucacagauauuaaucggaaccuuacuaauguggcuaggucuaaauaccaaaaauggaucaauaaguuuaauguguuuagcacuuggaggaguauuaauauuccugagcacagcaguaagugcggac

SEQ ID NO: 2548 - RNA, 2106 nt, Artificial Sequence
  ZIKV prME variant CDS opt
cgaauaauaaacgccagaaaagaaaaaaagagaagaggggcagauacaucuguggguaucguaggauuauuacuuacaaccgcuauggcggcggaaguaacaagaagaggaucagccuacuauauguaccuagacagaaaugaugcuggugaagcaauaucuuucccuacaacuuuaggaaugaauaaauguuacauccaaauaauggacuuaggacauaugugcgaugcaacuaugucguaugaauguccuauguuagaugaaggaguagaaccggaugacguugauugcugguguaacacaacaagcaccuggguaguauacgggacaugccaucauaaaaaaggggaagcaagacgaagccgaagagcuguuacuuuaccaagucauucaacgagaaaacuucaaacgagaucucaaacauggcuugaauccagagaauauacaaaacauuuaaucaggguagaaaacuggauuuuuagaaauccaggauucgcauuagcagccgcggcgauagcauggcugcuagggucaagcacaucucaaaaaguaauauaucuaguaaugauacuauuaauagccccagcauauucaauaagauguauaggaguaaguaacagagauuuuguagaaggaaugucugguggaaccuggguagauauaguauuagaacauggaggauguguaacugucauggcacaagauaaacccaccguagacauagaacugguaacaacaacaguaucaaauauggcugaaguacguaguuauugcuaugaagcaucaauaucagauauggccucagauucacgauguccuacccaaggagaagccuacuuagauaaacaauccgacacacaauacguguguaaaagaacauuagucgauagaggcuggggaaauggcuguggauuauuuggaaaaggaucacuaguaacaugugcaaaauucgcgugcucaaaaaaaaugacaggaaaauccauucaaccugaaaacuuagaauauagaauuauguuaaguguacacgggucacaacauagcggaaugauaguaaacgacacaggacaugaaacagacgagaacagagccaaaguagaaauaacaccaaauagcccaagagcugaagcaacacuagguggauucggaaguuuaggauuagacugugagccacgaacugguuuagacuucagcgaucuguacuauuuaacaaugaacaauaaacacuggcuaguacauaaagaaugguuccaugauauaccauugccauggcaugcaggagcagauacaggaacaccacauuggaauaauaaagaagcauuaguagaauuuaaagaugcacacgcaaaaagacagacgguaguaguuuuaggaucacaagaaggagcuguccauacagcucucgcgggcgcacuugaagcugaaauggacggagcgaaaggcagacuaucauccggucacuuaaaauguagacuaaaaauggauaaacuaagacuuaaaggaguaucauauucauuauguacugcugcauuuacauuuacuaaaauaccagcagaaacacuucauggaacgguaacuguagaaguacaauaugcugggacagauggaccaugcaaaguaccagcacaaauggcaguugacaugcaaacauugacaccaguuggaagauuaauuacagcaaauccuguaauaacagaaagcacagagaauucaaaaaugauguuagaauuagauccaccguucggagauagcuauauaguaauuggaguaggagaaaaaaaaauaacacaucauuggcacagaucaggaucaacuauaggcaaagcuuuugaagcaacaguuaggggcgcaaaaaggauggcaguauuaggagauacagcaugggacuuuggaagcguaggaggugccuuaaauagucuuggaaaaggaauacaucaaauuuuuggagcagcauuuaaaagucuauuugguggaaugaguugguuuagucaaauucuaauaggaacucuauuaauguggcuaggacuaaauacaaaaaacgggucaauaucauugaugugucuugcauuaggaggagugcuaauauucuuaaguacagccguaagcgcu

SEQ ID NO: 2549 - RNA, 2100 nt, Artificial Sequence
  ZIKV prME variant CDS opt
auaaacgcaagaaaggaaaaaaaaagaagaggugccgauacaucaguaggaauuguugguuuguuguuaacaacagcaauggcagcagaaguuacgagaagaggaucagcauacuacauguaucuugaccgaaacgaugcaggcgaagcaauaagcuuucccacaacauuaggaaugaauaaauguuauauucagauaauggauuuaggacauaugugcgaugcuacgaugaguuaugaaugucccaugcuagaugaaggaguugaaccagaugauguggauuguugguguaauacaacaucuacguggguaguauacggaacaugccaucauaaaaaaggcgaagcaagaagaucaagacgagcgguaacauuaccuucacauucaacuagaaaacuccaaacgagaagccagacauggcuggaaucaagagaauauacaaaacaucuuauuagaguagaaaacuggauauuucgaaauccagguuucgcuuuagcagcagcagcaauagcauggcuacuaggaucuucuacaucacaaaaaguaauauauuuaguaaugauuuuguuaauagcaccagcauacaguauaagguguauagguguaaguaauagagacuuuguagaaggaaugagcggaggaacguggguagacauaguauuagaacauggaggauguguuacaguaauggcacaggauaaaccuaccguagacauagaauuggucacaacuacagucagcaacauggcugaaguacgaaguuauugcuaugaagcuucaauuagugauauggcaucagauagcagguguccaacacaaggugaagcauauuuagauaaacaaagcgauacacaauauguauguaaaagaacauuaguagacagaggaugggggaaugguuguggacuauuugguaaaggaagcuuaguaacaugcgcuaaauuugcaugcucaaaaaaaaugacuggcaaaagcauacaaccagaaaauuuagaguaucgaauaauguuaucagugcacggaagucaacacucaggaaugaucgugaaugacacaggccaugaaacggaugaaaacagagcaaaaguagaaauaacuccaaacucaccaagagcagaagcaacacuaggaggauuuggaucauuaggacuagacugcgaaccuagaacaggacuagauuucucagauuuauacuaucuuacaaugaauaacaaacauugguuaguccauaaagaaugguuucaugauauuccauuaccauggcaugcaggagcugauacaggaacgccccauuggaauaauaaggaagcuuuaguagaauuuaaagaugcacacgcaaaaagacaaacaguaguuguauuagggagucaagagggugcaguacacacagcauuagcuggugcgcuagaagcagaaauggacggggcaaaaggaagacuuaguucuggacauuuaaaaugcagacuaaaaauggauaaauuaagauuaaaaggcguaaguuauaguuuaugcacugcugcauucacauuuacaaaaauaccagcagaaacauuacauggaacgguaacaguagaaguacaauaugcaggaacugauggaccaugcaaagugcccgcacaaauggcaguggauaugcaaacgcucacaccaguaggaagauuaauaacagcuaauccagucauaacagaaucaacugaaaauucaaagaugauguuagaauuagacccaccuuuuggagauucauacauuguaauaggaguaggagaaaaaaaaauaacacaucauuggcauagaaguggaucaacaauaggaaaagcauuugaagcaacaguacgaggggccaaaagaauggcaguacuaggagauacagcaugggacuuuggaucgguagggggagcucuaaauuccuuaggaaaaggcauacaucaaauauuuggagcggcguucaaaucuuuauuuggcgguaugucuugguucucucaaauuuuaauaggaacccuucuaaugugguuagguuuaaauacuaaaaauggaucuaucagcuuaaugugcuuagcccuaggagguguauuaauuuuuuuaucaacagcaguuucagcu

SEQ ID NO: 2550 - RNA, 2103 nt, Artificial Sequence
  ZIKV prME variant CDS opt
auaauaaaugcuaggaaagaaaaaaaaagacggggagcagauacaaguguaggaauaguaggauuacuacuaacaaccgccauggcagcagaagucacaagaagagguucagcauacuauauguacuuagacaggaacgaugcaggagaagccauuaguuuuccgacaacacuagguaugaacaaauguuauauacaaauaauggauuuaggacauaugugcgaugcaacaaugucauaugaaugcccaauguuagacgaaggaguagaaccagaugaugucgauuguuggugcaauacaacaucaacauggguaguauacgguacgugucaucacaaaaaaggcgaagcacguagaagucgaagagcaguaacucuaccaagccauaguacaagaaaacuacaaacucgaucacaaacgugguuagaaagcagggaauauacuaaacacuuaauaagaguagaaaacuggauauuucgaaauccagguuuugcuuuagcugcagcagcaauagcauggcuauuagggucauccacgucacaaaaaguaauauauuuaguaaugauauuacuaauagcaccagcguacuccauaagauguauaggaguuagcaauagagacuucguugaaggaaugucugguggaacauggguugauauaguccuugaacacggaggauguguaacggucauggcacaagauaaaccaacuguugauauagaacuaguaaccacaacaguaagcaauauggcagaagucagaucauauuguuacgaagccaguauaagcgauauggcaucagauucaagauguccaacucagggugaagcauauuuggauaaacaaucagauacacaauaugucugcaaacgcaccuuaguagauagagggugggguaaugguuguggacuauuuggaaaaggaucacuaguaacaugcgcaaaauucgcauguucaaaaaaaaugacagggaaauccauacaaccagaaaauuuagaauacagaauaaugcuaucaguccauggaucacaacauagugguaugauuguuaaugauacaggucacgaaacagaugaaaauagagcaaaaguagaaauaacaccaaauaguccaagagcagaagcaacauugggaggauuuggaucucuaggucuagauugugaaccuagaacaggacuggacuuuagugaccuuuauuacuuaacaaugaacaauaaacauuggcuaguacauaaagagugguuccaugauauaccacuaccauggcaugccggagcagauacaggaacuccccacuggaauaauaaagaagcucuaguagaauuuaaagacgcacaugccaaaagacaaacaguagucguauuaggaucccaagaaggagccguacauacagcacuagccggagcauuagaagcagaaauggauggagcaaaaggacgacugagcucaggucaucuaaaauguagauuaaaaauggacaaauuaagauuaaaaggggugucauacagucuauguacagccgcauuuacuuucacaaaaauaccagcugaaacauuacacggcacagugaccguugaaguacaauaugcaggaacagaugguccaugcaaaguacccgcacaaauggcagucgauaugcaaacauuaacaccaguaggaagauuaaucacagcaaauccaguaauaacagaaaguaccgaaaauucaaaaaugauguuggaauuagauccaccauuuggagauaguuauauaguaauaggaguuggagaaaaaaaaaucacccaccacuggcacagaaguggcaguacaauagguaaagcguucgaagcaacugucagaggagcaaaaagaauggccguacuuggagacacagcaugggauuuuggaucaguuggcggcgcucugaacucccuaggaaaaggaauccaucaaauauuuggagcagcauuuaaaaguuuauuuggagguaugaguugguucucacaaauacuaauuggaacacuucuaauguggcuaggacuaaauacaaagaacggcaguauaucauugauguguuuagcgcuaggaggcguacuaaucuuucuaagcacagcgguuucagcu

SEQ ID NO: 2551 - RNA, 2097 nt, Artificial Sequence
  ZIKV prME variant CDS opt
aaugcaagaaaagaaaagaaaagaagaggugccgauacauccguagguauaguuggcuuauuauuaacaacagccauggcagcugaagugacuagaagagguucagcauauuacauguaucuagauagaaaugacgcaggagaagcaauaaguuuucccacuacauuaggaaugaauaaauguuauauacaaauaauggaucuuggacacaugugcgaugcuacaaugaguuaugaauguccaauguuagaugaaggaguggaaccagaugauguagauuguugguguaacacgacaucaacuuggguaguuuauggaacaugucaucauaagaaaggagaagcaagacgaucaagacgagcaguaacacucccaagccacucuacaagaaaauuacagacaagaucacaaacaugguuagaaucccgagaauacacaaaacaccuaauuagaguagagaacuggauuuuuaggaauccaggauuugcauuagcggccgcugcaauagcauggcuacuaggaucaaguacaagucaaaaagucaucuauuuaguaaugauauuauuaauagccccugcauacucaauaagauguauuggcguaaguaauagagacuuuguagaagggaugaguggaggaacuuggguagauauaguauuagagcauggaggauguguaacaguaauggcacaagacaaaccaacuguagauauugaguuaguaacaacaacugugaguaacauggcagaaguaagauccuauugcuacgaagcauccauuucagauauggcuucagauaguagauguccaacucaaggagaagccuaucuagacaaacaaagugacacacaauauguuuguaaaagaacauuaguagauagaggaugggguaauggauguggcuuauucggaaaagguucauuaguuacaugcgcaaaauuugcuuguucaaagaaaaugaccggcaaaucaauucaacccgaaaauuuagaauauagaauaaugcucaguguacacggaagccaacauucagguaugauaguaaacgauacugggcaugaaacagacgaaaauagagcuaaaguagaaauuacaccaaauuccccaagagcagaagcuacauugggaggauuugggagucuaggacuugauugugaaccaagaacaggucuagacuucagugaucuguacuaucuuacaaugaauaacaaacauuggcuuguccauaaagaaugguuucacgacauaccacuaccauggcaugcaggagcagauacuggaacgccacacuggaauaacaaagaagcauuaguugaauuuaaagaugcacaugcgaaaagacaaacaguaguaguuuuagguagccaagaaggagcuguacauacagcauuagcaggagcauuagaagcagaaauggauggagcgaaagguagauuaucaucaggacaucuaaaaugucgacuaaaaauggauaaauuaagacucaaaggaguuucauacucauuauguacagcagccuuuacuuucaccaaaauaccagcagaaacacugcauggaacuguaacaguugaaguacaauacgcaggaacagauggaccauguaaaguaccagcgcagauggcaguagauaugcaaacacucacaccuguagguagacuaaucacagcaaauccgguaauaacagaaaguacagaaaauucuaaaaugaugcuagaacuagauccgccauucggagacagcuacauaguaauaggaguuggugagaagaaaauaacacaccauuggcacagaucaggaaguacaauaggaaaagcauuugaagcaaccguaagaggagccaaaaggauggcagucuuaggagauacagcaugggauuuuggaaguguagggggugccuuaaauuccuuggguaaagguauacaucaaauuuuuggagcagcauuuaaaucauuauuuggcggcauguccugguucucacaaauacugauaggaacucuauuaauguggcuuggcuuaaauacgaaaaauggaaguauaucauugaugugccuagcauuaggcggaguucuaauauuuuuaaguacagcaguaucagca

SEQ ID NO: 2552 - RNA, 2094 nt, Artificial Sequence
  ZIKV prME variant CDS opt
gcaagaaaagaaaagaaaagaagaggagcggacacaagugugggaauaguaggacuauuauuaacaacagcuauggcagcagagguaacgaggagaggaucagcauauuauauguaucuagaccgaaaugaugcaggagaagcuauuucauucccaacgacucuaggaaugaacaaaugcuacauacaaauaauggacuuaggacauaugugugacgccacaaugaguuaugaaugcccaaugcuagaugaaggcguagaaccagaugacguagauuguuggugcaauacaaccucgaccuggguagucuacggaacaugucaccauaagaaaggagaagcaagaaggucaagacgagccgucacuuuaccuagccauucaacacgaaaacuacaaacaagaucacaaacauggcuagaaaguagagaauauaccaaacauuuaauaagaguagaaaauuggauauucagaaacccaggauucgcauuagcugcagcagcuauagcuuggcuauuaggcagcucaacaagucaaaaagugauauaucugguaaugauacuacuuauagcuccugcauacucaauuagauguauaggcguaucaaauagagauuuuguugaaggaaugagcggaggaacauggguagacauaguauuagaacacgguggaugugugacaguuauggcacaagauaaaccaacaguagauauugagcuaguuacuacaacaguaucaaacauggccgaaguaagaaguuacugcuacgaagcaucaauaagugauauggcaucagauagcagauguccaacccaaggugaagcauauuuagauaaacaaucagauacucaauauguuuguaaaagaaccuuaguagauagaggauggggaaauggauguggguuauuuggaaaaggaaguuuaguaacaugcgcuaaauuugccuguucgaagaaaaugacaggaaaaucuauucaaccagaaaaucuagaauaccgaauaaugcuuagcgugcauggaagucaacacagcggaaugauagucaacgauacuggacaugaaacggaugaaaacagagcaaaaguugaaauaacaccgaauagucccagagcagaggcaacauuaggaggauuugguuccuuaggacuagacugcgagccaagaacaggccuagauuucagcgauuuauauuaucuaacuaugaacaauaaacacugguugguccauaaagaaugguuucaugauauacccuuaccuuggcaugcuggugcagauacaggaacaccacauuggaauaauaaagaagcacuuguagaauuuaaagaugcacaugcaaaaagacaaacaguaguagucuuaggaucucaagagggagcaguacacacggcacuugcuggggcauuagaagcagaaauggauggagcuaaaggucgauuaaguaguggacacuuaaaaugccgauuaaaaauggacaaauuaagauuaaaaggaguaucauauucacuaugcacagcugcuuucacauuuacaaaaauaccagcugaaacacuacauggaacaguaacaguagaaguacaauacgcaggaacagauggaccguguaaaguaccagcacaaauggcaguggauaugcaaacacuuacgccaguaggaagauuaauaacagcuaaucccguaauuacugaaaguacagaaaauucuaaaaugaugcuagaacuagacccaccuuucggugauaguuauauaguaauaggaguaggagaaaagaaaaucacacaucauuggcaucgaucaggaaguacaauaggaaaagcauuugaagcuacaguaagaggcgcuaaacgaauggcaguucugggagauacugcaugggauuuuggaaguguaggaggagcacuaaacucauuaggaaaaggcauccaccaaauauuuggagcugcauuuaaaagucuauucggagguaugucaugguucagucaaauauuaauaggaacguuauugaugugguuaggcuuaaauacuaaaaacgguucaauuucacuaaugugucuagcacuaggaggaguauuaauauucuuaaguacggcaguaagugca

SEQ ID NO: 2553 - RNA, 2091 nt, Artificial Sequence
  ZIKV prME variant CDS opt
cggaaagaaaaaaaaagaagaggugcugauacaaguguaggaaucguaggacuauuauuaacaacagccauggcagccgaaguaacaaggagaggcuccgcauauuauauguaucuagaucgaaacgaugcuggugaagcaauaucuuuuccaacaacacuaggaaugaauaaauguuauauacaaauuauggaucuagggcauaugugcgaugcaacuaugaguuaugaaugcccaauguuagacgaggguguagaacccgaugauguugauuguugguguaauacaacaagcacauggguaguauauggaacaugccaccacaaaaaaggugaggcaagaagaagccgaagagcuguaacauuaccaucacauagcacuagaaaauuacaaacgagaagccaaacaugguuagaaucaagagaguacacuaagcaucuaauuagaguagaaaacuggauauuuagaaauccaggauucgcacuugcagcagcggcaauagcauggcuauuaggaucaucaacaagucaaaaaguaauauauuuaguuaugauacuuuuaauagcacccgcauauagcaucagaugcauuggaguaucaaauagagacuuugucgaagguaugucuggagguaccuggguagauauaguauuagaacaugguggauguguaacgguaauggcacaagacaaaccaacuguggauauagaacuaguaacuacaacaguaaguaauauggcagagguaagaucuuacugcuaugaagcaucaauaucagacauggcaagcgacucaagaugcccgacacaaggagaagccuauuuagauaaacaaucggacacgcaauauguuuguaaacgcacuuuaguagauagaggaugggguaauggaugugguuuauuuggaaaaggaagcuuaguuacaugugcuaaauucgcauguucaaaaaaaaugacaggaaaaucaauacaacccgaaaacuuggaauaucgaauaauguuaagcguacaugguucacaacacucagguaugauugucaaugacacaggucaugaaacagacgaaaacagagcaaaaguagaaauaacgccaaacucaccuagagcugaagcaacacuaggugguuuuggaucucugggacuagauugcgaaccaagaacaggacucgauuucagugauuuauauuacuuaacuaugaauaauaaacacuggcuaguccacaaagaaugguuucaugauauaccacugccauggcacgcaggugcagauaccgguacaccccauuggaauaacaaagaagcacuaguggaauuuaaagaugcacaugccaaacgucaaacagugguaguuuuaggaagucaagaaggagcaguccauacggcucuagcaggugcacuagaggcagaaauggauggggcuaaaggaagauuaucaaguggacauuuaaaguguagacuaaaaauggauaaauugagauuaaaagggguaaguuacucauuaugcacagcugcauuuacauucacaaaaauuccagcagaaacacuacauggcacaguaacaguagaaguccaauacgcaggaaccgaugguccguguaagguaccugcacaaauggcaguagacaugcaaacauuaacaccagucggccgacuaauaaccgcaaauccaguaauuacagaaaguacagaaaauaguaaaaugauguuagaauuagauccaccauuuggagauuccuacauuguuauaggaguaggugagaaaaaaauaacgcaucauuggcacagaaguggaaguacuauaggcaaagccuuugaagcuacaguaagaggggcgaaaagaauggcaguauuaggagauacagcuugggauuuuggaagugucggcggcgcacuuaauaguuuaggcaaagguauucaccaaauauuuggagcggcauucaaaucacuauucggaggaaugucuugguuuucucaaauauuaauaggaacauuacuaaugugguuaggacuaaauaccaaaaauggcuccauaucacucauguguuuagcauuaggagggguacuaauauucuuaagcacagcaguaucagca

SEQ ID NO: 2554 - RNA, 2088 nt, Artificial Sequence
  ZIKV prME variant CDS opt
aaagaaaaaaaaagaagaggagcagauacaaguguagguauaguaggauuguuacuaacaacagcuauggcagcagaaguaacaagaagaggaagugcauauuauauguaccuagauagaaaugaugcaggugaagcaauaaguuuuccaacaacauugggaaugaauaaauguuauauacaaauaauggauuuaggacauaugugugacgcuaccaugucauacgaauguccaaugcuagaugaaggaguagaaccagaugauguagacuguugguguaacacuacuucaacauggguaguauauggaacaugccaucauaaaaaaggagaagcaagaagaucaagaagagcaguaacacuaccaucacauucuacaagaaaauuacaaacacgaagccaaacauggcuugaaucacgagaauauacaaaacaucuaauacguguagaaaacuggauauuuagaaacccgggauucgcuuuagcagccgcugcaauagcauggcugcuagguucaucaaccucacaaaaagucauauaucuaguuaugauacuacuaauagcucccgcauacucaaucagauguauaggaguaagcaauagagauuuuguugaaggaaugucaggagguacauggguagauauaguguuagaacauggaggauguguaacaguaauggcgcaagauaaaccaacaguagauauagaauuaguaacaacuacaguaaguaacauggcugagguuagaaguuacuguuacgaggcgucuauaagcgauauggcaucagacaguagauguccaacccaaggugaagcauauuuagauaagcagagugacacacaauauguaugcaaaagaacguuaguugaucgaggauggggaaauggauguggauuauuugguaaaggaagucuaguaacaugugccaaauuugcauguaguaaaaaaaugacaggaaaaagcauacaaccugaaaaucuagaauauaggauaauguuaaguguacauggaagccaacacucuggcaugauuguaaaugacacaggucaugaaacggacgagaacagagcgaaaguagaaauaaccccgaauagccccagagcugaagcaacauuagggggauuugguagucuagguuuagauugugaaccaagaacaggguuagauuuuagugauuuauauuacuugacaaugaacaacaaacauuggcuaguacacaaagaaugguuucacgauauaccacuacccuggcaugcuggagcggacacagguacaccccacuggaauaauaaagaagcucuagucgaauuuaaagaugcacaugcaaaaagacaaacaguaguaguuuuaggaucacaagaaggagcaguacauacggcacuagcaggagcguuagaagcagaaauggauggggcuaaagggcgauuaucaucaggacacuuaaaaugucgauuaaaaauggauaaacuaagauuaaaaggaguaucauauaguuuaugcacagcagcauuuacuuuuacaaaaauaccagccgaaacacuucaugguacuguaacaguggaaguccaguaugcuggaaccgauggaccauguaaagugccagcgcaaauggcaguagauaugcaaacauuaaccccgguaggcagacuuauaacugccaacccuguaauaacagaaucaacggaaaacucaaaaaugaugcuugaauuagauccgccauuuggagacagcuacauuguaauagguguaggagaaaaaaaaauaacacaccacuggcauaggucaggaucgaccauugguaaagcguuugaagcaacaguacgaggagcuaaaagaauggcaguacuuggagacacagcuugggauuuugguucuguaggaggugcauuaaacagccuaggaaaaggaauacaucaaauauuuggagcagcuuuuaaaagucuauuugguggaaugaguugguuuagccaaauauuaauuggaacguuauuaaugugguuaggguuaaauacaaagaacgguaguauuagucuuaugugcuuagcuuuaggaggaguacuaauauuuuuaagcacagccguaucagca

SEQ ID NO: 2555 - RNA, 2085 nt, Artificial Sequence
  ZIKV prME variant CDS opt
gaaaagaaaagaagaggggcggauacauccguaggaauaguuggacuauuauuaacaacugcaauggccgcagaaguaacacguagaggaucagcuuauuauauguaucuagauagaaacgaugcaggagaagcuauaaguuuuccaacaacacuaggaaugaauaaauguuauauacaaauaauggaccucggccacaugugugacgcuacaaugucuuaugaaugucccauguuagaugaaggagucgaaccagaugacguagauugcugguguaauacaacaucuacuuggguaguauaugguacaugucaucacaagaaaggugaagcaagaagaucacgaagggcaguaacuuuaccaucucacagcacuagaaaauuacaaacuagaagccaaacaugguuagaaucuagagaauauacaaaacauuuaauacgaguagaaaauuggauauuuagaaacccugguuuugccuuggcagccgccgcuauagcaugguuacuaggaucaucaacaagccaaaaaguaauauaccuaguuaugauacuacuaauugcaccagcauauucaauuagguguauaggaguuagcaauagagauuuuguagaagguaugucagguggaacauggguagacauuguauuagaacacggagguugugugacuguaauggcgcaagauaaaccaacaguagacauagaauuaguaacuacaacuguaaguaacauggcagagguaagaucguauugcuaugaagcaaguauaagugacauggcuucagauucaagauguccaacacaaggugaggcauaucuagacaaacaaucagacacacaauacguauguaaaagaacuuuaguagaccgcggcuggggaaacggaugcggacuauuugguaaaggaaguuuaguaacaugcgcaaaauucgcauguucuaagaaaaugacaggaaaaucaauacaaccugaaaaucuagaauauagaauaaugcuaaguguacauggaagucaacauucaggaaugauugugaacgacacuggacaugaaaccgaugaaaauagagcaaaaguagaaauaacaccaaauucgccaagagcagaagcaacucuuggggguuuuggaucauugggauuagauugcgagccuagaacaggauuagauuucagcgaucuuuauuacuugacaaugaauaauaaacauugguuaguacauaaagaaugguuccaugauauaccacuaccauggcaugcgggagcagauacugguacaccucauuggaacaauaaagaagcacugguagaguucaaagaugcccaugcaaaacgacaaacaguaguaguauuagggucacaagaaggagccguucacacagcacucgcuggcgcauuagaagccgaaauggauggcgcaaaaggaagauugucuucaggacaucuaaaaugccgauuaaaaauggacaaauuaagacuaaaagggguaagcuauucauuauguacagcggcauuuacauuuacaaaaauaccugcagaaacucuacauggaacaguaacaguggaaguacaauaugcagguacugacgguccuuguaaaguaccagcacaaauggcaguagacaugcaaacuuuaacaccaguagggagauuaauuacugcgaauccaguuauaacagaaaguacagaaaauucaaaaaugauguuagaauuagauccaccauucggagauagcuauauaguaauagguguaggagaaaagaaaauaacucaucacuggcacagaaguggauccacaauaggaaaagcauucgaagcaacaguaagaggcgcaaaaagaauggcaguauuaggcgacacugcaugggauuuugggucaguaggaggagcauugaauagucucgguaaagguauccaucaaauauuuggagccgccuuuaaaaguuuauucggaggaaugucuugguuuucucaaaucuuaauagguacacuacuaauguggcucggacuaaauacgaaaaauggcucgauaucacuaauguguuuagcucuaggagguguacuaauauuuuuaucaacagcagugagcgcc

SEQ ID NO: 2556 - RNA, 2082 nt, Artificial Sequence
  ZIKV prME variant CDS opt
aagaaaagaaggggagcagauacaaguguaggaauaguaggacuauuacugacaacagcaauggccgcggaaguaacaagaagaggaucagcuuacuacauguacuuagaccgaaaugaugcaggagaagcaauaucguuuccaaccacauuaggaaugaauaaauguuauauacaaauaauggauuuaggacauaugugugacgcaacaaugagcuaugaaugcccaaugcuagaugaaggagucgaaccugaugauguagauuguuggugcaacacaacuagcacuuggguaguauacggaacaugucaccauaagaaaggugaagcuagacgaaguaggagagcuguaacauuacccagucauagcacaagaaaauuacagacaagaagccaaacaugguuagaaucaagagaauacacaaaacaccuaauaagaguagaaaauuggauauuuagaaauccaggcuucgcucuggcagcagcagcgauagccuggcuacuaggaaguucgacaagucaaaaaguaauauauuuaguuaugauuuuacugauugcuccagcauauaguauaagauguauaggagucaguaaccgagauuuuguagaaggcaugucaggaggaacauggguagauauuguauuagaacauggagguugugucacaguaauggcacaagacaaaccaacaguagauauagaauuaguaacaacuacaguaaguaauauggcagagguaagaucauauuguuaugaagcauccauaagugauauggcaucagauucaagauguccuacucagggagaagcauauuuagauaaacaaagugauacacaauauguauguaaaaggacauuaguagaccguggauggggaaauggauguggacuauuuggaaaaggaucauuaguuacaugcgcaaaauuugcauguucuaagaaaaugacagguaaaagcauacaaccagaaaauuuagaauaucgcauuaugcuaucaguucauggaucccaacauucagguaugaucgugaacgauacagggcaugaaacagaugaaaauagagcaaaaguagaaauaacaccaaacagcccaagagcagaagcaacuuuaggcggcuuuggaaguuuaggauuagacugugaaccaagaacagguuuagauuuuucagaucuauacuauuuaacaaugaacaauaaacauugguuaguccauaaagaaugguuucacgacauacccuuaccauggcacgcgggugcagauacagguacuccacauuggaacaacaaagaagcauuaguagaauuuaaggacgcucaugcaaaaaggcaaacugugguaguauuaggaucacaagagggagcuguucacacagcauuagcaggagcucuagaagcagagauggauggagcaaaaggaagauuaaguucgggacaucuaaaaugucgacuaaaaauggacaagcuaagauuaaaaggaguaaguuauagucuaugcacagcagcuuuuacauuuaccaaaauaccagcugaaacgcuacaugggacaguaacaguagaaguacaauaugcagguacagaugggccuuguaaaguaccagcacaaauggcaguagauaugcaaacacuaacaccaguaggacgauuaauaacagcaaauccagugauuacugaaagcacagaaaacaguaaaaugaugcuagaauuagacccacccuuuggagacaguuauauaguaauaggcguaggagaaaagaaaauaacucaucacuggcauagaaguggaagcacaauaggaaaagcauuugaagcaacaguuagaggagcaaaacgaauggcugugcuaggagauacagcuugggauuuuggcucaguaggaggggcauuaaauucauuagguaaaggaauacaucaaauauucggugcagcauuuaaaagucuauuugguggaaugaguugguuuucacaaauauuaauagguacucuacuaaugugguugggauuaaacacgaaaaacggaucaaucagucuaaugugccuagcgcuugggggcguguuaauauuuuuaaguacagcaguaagugca

SEQ ID NO: 2557 - RNA, 2079 nt, Artificial Sequence
  ZIKV prME variant CDS opt
aaaagacguggagcugauacaagugucggcauuguaggucuguuauuaacaacagcaauggccgcagaaguaacaagaagaggaucagcauauuauauguauuuagauagaaaugaugccggagaagcaauaucuuuuccuacaacauuagggaugaauaaaugcuauauucaaauaauggauuuagggcacaugugugaugcaacgaugaguuacgaaugcccaauguuagaugaaggaguagaaccggacgauguagauuguugguguaacacuacaucaacauggguuguuuacggaacaugucaucauaagaaaggagaagcaaggagaagucgcagagcagucacauuaccuagucacucaacaagaaaauuacaaacaagaagucaaacaugguuagaaaguagagaauauaccaaacaucuaauaagagucgaaaauuggauuuuuagaaacccgggauucgcacuggcagcagcugccauugcauggcuccugggaucaaguacgucacaaaaaguaauauauuuaguaaugaucuuauuaaucgcaccggcauacucaauuagauguauaggaguaagcaacagagauuuuguagaagggaugucagguggaacauggguagauaucguauuagaacauggcgggugugucacaguaauggcacaagauaaaccuacaguugauauagaauuagugacaaccacaguuaguaauauggcagaaguacgaucauauuguuaugaggcuuccauaucagacauggcaagugacucacgaugcccaacucaaggagaagccuauuuagacaaacaaucugauacacaauacguaugcaaaaggaccuuagucgacagagguuggggaaauggaugcggacuauuugggaaagguagcuuaguaacaugugcaaaauuugcaugcucgaagaaaaugacaggaaaaagcauacaaccagaaaauuuagaauauagaauaauguuaagcguucauggaucacaacacaguggaaugauaguaaaugauacagggcaugaaacagacgaaaauagagcuaaaguagaaauaacuccaaacagcccaagagcggaagcaacauuaggaggauuuggaaguuuaggacuagauugcgaacccagaacaggacuggacuuuagcgaccuauauuauuuaacaaugaauaauaaacauuggcugguucauaaagaaugguuucaugauauuccuuuaccguggcaugccggugcagauacagguacaccacauuggaauaacaaagaagcacucguagaauuuaaagaugcacaugcaaaaagacaaacaguaguagucuuaggaucccaagaaggagcaguacacacugcucuagcgggagcccuagaagcagaaauggacggcgcuaaaggaagauuaucuucaggacaucuaaaauguagacuaaaaauggauaagcuaagauuaaaaggcguaucuuauagccuauguacugcagcuuuuacauuuacaaaaauaccagcagaaacuuuacauggaacaguaacaguagaaguacaauacgcaggaacugacggaccaugcaaaguucccgcacaaauggcagucgacaugcagacacuaacaccaguuggaagauuaauaacagcaaauccaguaauaacagaaucaacagaaaauucuaaaaugaugcuugaauuagacccgcccuucggagauucauauauaguaauugguguaggagaaaagaaaauaacccaucacuggcacagaaguggauccacaauagguaaagcauuugaagcaacaguaagaggugccaaaaggauggcaguccuaggagauacagccugggauuuuggaaguguugguggggcacuuaacaguuuaggaaaaggaauacaucaaauuuuuggagcagcauucaaaagucuauucggaggaaugaguugguuuucacaaauacuaaucggaacacuauuaaugugguuaggauuaaauacuaaaaacggaagcauaucauuaaugugucuugcauuaggcggagugcuaaucuuuuuaagcacagcaguaagcgca

SEQ ID NO: 2558 - RNA, 2076 nt, Artificial Sequence
  ZIKV prME variant CDS opt
agaaggggugcggauacaucuguaggaauaguaggauuauuauuaacaacggcaauggcagcagaaguuacaagaagaggaagugcuuacuacauguauuuagauagaaacgaugcuggugaagccauaaguuucccaacuacauuaggaaugaacaaaugcuacauccaaaucauggaccuuggacauaugugugaugcuacaaugucauacgaauguccaaugcuggaugaagguguagaacccgaugauguagacuguugguguaacacaacaucuacuuggguuguuuaugguacgugucaccauaagaaaggugaagcaagacgaucaagacgagcaguaacauuacccagucacucaaccagaaaacuacaaacaagaucacaaacaugguuagaaucaagagaauauacaaaacaucuuauaagaguagaaaacuggaucuuuagaaacccuggauuugcauuagcagcagcagcuauagcaugguuacuagguucgaguacaagucaaaaaguuauuuaucucguaaugauacuauuaauagcaccagcuuauagcauaagauguauagguguaucaaauagagauuuuguagaagggaugucaggagggacauggguagauaucguauuagaacauggaggauguguaacagucauggcgcaagacaaaccaacaguugauauagaauuaguaacaacaacaguuuccaauauggcagaaguuagaucauauuguuaugaagcuagcaucucagauauggcuuccgacucaagauguccaacacaaggagaagcauauuuagacaaacaaucugauacacaauauguauguaaaagaacucuaguagauagagguuggggaaaugguuguggauuauuuggcaaaggaucuuuaguuacaugcgcaaaauuugcauguaguaagaaaaugacaggaaaaagcauucaaccugaaaauuuagaauauagaauaaugcuaucaguacacggaagucaacauagcgguaugauaguaaacgauacaggacaugaaacagaugaaaacagagcaaaaguggaaauaacaccaaacucaccuagagcagaagcaacauuaggcggauuugguaguuuaggauuagacugugaaccaagaacaggguuagauuuuagugauuuguauuauuuaacaaugaauaacaaacauuggcuaguacauaaagaaugguuccacgauauaccauuaccguggcaugcaggggcagauacuggaacuccccauuggaacaauaaagaagccuugguagaauuuaaagacgcacaugcaaaacgacaaacagucguaguauuaggcucacaagaaggcgcaguacauaccgcuuuagcaggcgcuuuagaagcagaaauggauggagccaaaggaaggcuaucaucuggucaucuuaaauguagacuaaaaauggauaaacuaagacuaaaaggaguuucuuacagucucuguacagcagcauuuacauucacgaaaauaccagcugaaacacuacauggaacuguaacaguagaaguacaauaugcaggaaccgauggaccauguaaaguaccagcacaaauggcaguugauaugcaaacauuaaccccaguagggagacuaauaaccgcaaauccaguuauuacagaaucaacagaaaacaguaaaaugaugcuagaauuagaucccccuuuuggcgauucauacaucguaauaggugugggagaaaagaaaauaacgcaucacuggcaucgaucaggaagcacaauaggaaaagcauuugaagcuacagucagaggagcuaaaagaauggccguucuaggagacacugcuugggacuucggaucaguugguggagcauuaaauucucugggaaaaggaauacaucaaauauuuggugcagccuucaaaucacuauuugguggcaugaguugguucucacagauacuaauagguaccuuauuaauguggcuaggauuaaauacuaaaaacggaucaauaucauugaugugcuuagcccuaggaggaguuuuaauauuucuaagcacagcugucagugca

SEQ ID NO: 2559 - RNA, 2073 nt, Artificial Sequence
  ZIKV prME variant CDS opt
cgaggagccgauacaagcguuggaauaguugguuuauuauuaacaacagcuauggcagcagaaguaaccagacguggaucggcauauuauauguaccuagacaggaaugaugcaggagaagcaauaucuuuucccacaacuuuaggaaugaauaaaugcuauauacaaauaauggauuuaggacauaugugugaugcaacuaugagcuaugaaugcccuauguuggaugaagggguugaaccagaugauguagauuguuggugcaacacuacaucaaccuggguuguauauggaacaugucaucacaagaaaggagaagcucgcagaagcagacgagcaguaacacuaccuucacauagcacaagaaaacuacaaacacgaucucaaacaugguuagaaagcagagaauacacaaaacaccuaauaaggguagaaaauuggauauuuagaaacccaggguuugcauuagcagcagcggcuauagccuggcuauuaggaucuaguacaucacaaaaaguaaucuacuuagugaugauauuauuaauugcaccagcauacucaauaagauguauaggaguuagcaauagagauuucgucgaaggaaugucaggcggaacauggguagauauuguauuggaacauggaggaugcguaacaguaauggcacaagauaaaccuacuguagacauagaauuaguaacaacaacuguaagcaacauggcagaaguaaggucauauuguuacgaagcaaguauaucagauauggcaagugauucgagauguccaacacaaggcgaagcauauuuagacaaacaaucagauacacaauauguauguaaaagaacccuaguagauagaggauggggaaauggauguggucuauuuggaaaaggaaguuuaguaacaugcgcuaaauucgcaugcagcaagaaaaugacaggaaaaucuauacaaccagaaaauuuagaauacaggauaauguuaucaguccacggaagucaacauucaggaaugauagucaaugacacaggacaugaaacugacgaaaauagagcaaaaguagaaauaacaccaaacucaccaagagcagaagcaacacuagguggcuucgguucauuaggacuggacugugaaccaagaacaggauuagacuucagcgauuuauacuacuuaacuaugaauaacaaacauuggcuaguacauaaagaaugguuccaugacauaccauuaccuuggcaugcuggugcagauacuggaacaccacauuggaauaauaaagaagcgcuaguggaguucaaagaugcacaugcuaaacgacaaacaguaguaguauuaggcucacaagaaggagccguccauacagcacuugcaggagcacuugaagcagaaauggauggagcaaaaggaagauuaucgaguggccacuuaaaaugucgacuaaaaauggauaaacuaagauuaaaaggaguuucauauaguuuauguacagcagcauuuacauucaccaaaauuccagcagaaacauuacauggaaccguaacuguggaaguacaauaugcaggaacagauggacccuguaaaguaccagcacaaauggcagucgauaugcaaaccuuaacaccaguaggaagauuaaucaccgcaaacccugugauaacagaaucuacagaaaacaguaaaaugaugcuagaauuggauccuccauucggagauuccuauauaguaauaggaguaggagaaaagaaaauuacucaccacuggcacagaucagguagcaccauagguaaagcauuugaagcuacaguaagaggugcaaaaaggauggcuguauuaggcgacacagcaugggauuucggaucaguuggaggcgcuuuaaacucacucggaaaaggcauucaucaaauauuuggagcagcauuuaaaaguuuauuuggaggaaugucaugguuuucacaaauucuaauaggaacauuacuaauguggcugggucucaauaccaaaaacggcaguaucagcuugaugugucuagcauuaggaggcguacuaauauuccuaagcacagcaguaucagcu

SEQ ID NO: 2560 - RNA, 2070 nt, Artificial Sequence
  ZIKV prME variant CDS opt
ggcgcagauacaaguguaggaauuguaggguuauuacuaacaacagcaauggcagcagaaguaacaagaagagguagugcauauuauauguaucuugauagaaacgaugcaggagaagcuauuucauuuccaacaacacuaggcaugaauaaauguuauauacaaaucauggauuuaggacacaugugcgaugcuacaaugaguuaugaauguccaaugcuagacgaaggcguugaaccagaugauguagauugcugguguaacacaacaaguacuuggguaguuuauggcaccugucaucacaagaaaggagaagcgcgaagaaguagacgagcaguaacauuaccaucacauagcacaagaaaauugcagacuagaagucaaacauggcuugaaucaagagaauauacaaaacauuuaauacgaguugaaaacuggauauuccgaaauccagguuuugcacuagcagcagcagcaauagcauggcuacugggaucaaguacuagccaaaaaguaauauauuuaguaaugauauuacuaauagcccccgcguacaguauaaggugcauagguguaucgaauagggauuuuguugaaggaaugagcggagggacuuggguggauauaguacuagaacauggagguuguguuacaguaauggcacaagauaaaccaacaguugacauagaauuagugacaacaacuguaagcaauauggcugaaguaaggagcuauugcuaugaagcaaguauaucagauauggcaagugauucaagauguccaacacaaggugaagcauacuuagauaaacaauccgauacucaauauguauguaaaagaacucuaguagaucgaggauggggaaacggauguggauuauuuggaaaagggaguuuaguaacaugcgcaaaauuugcauguaguaagaaaaugacaggaaaaucaauacagccagaaaaucuagaauaucggauaaugcuaucaguacaugguagucaacauucaggaaugauaguaaacgauacaggucacgaaacagacgaaaaucgagcaaaaguugaaauaacaccuaacaguccacgagcugaagcaacauuaggcggauuuggaucccuaggauuagacugugaaccgaggacaggacuagauuuuucagaucuauauuauuuaacaaugaacaauaaacauuggcuaguucauaaagaaugguuucaugauauaccauuaccauggcaugcuggugcagacacaggaacaccucauuggaauaauaaagaagcauuaguagaauuuaaagacgcacacgcaaaaagacaaacaguuguaguauuaggaagccaagaaggagcuguacauacagcacuugcuggagcacuagaagcugaaauggauggugcuaaaggcagauuaagcaguggucauuuaaaaugcagauugaaaauggauaaauuacgauuaaaaggaguaucauauuccuuaugcacagcagcauuuacauuuacaaaaauaccagcagaaacauuacauggaacaguaacaguagaaguccaauaugcaggaacagacggaccaugcaaaguaccagcacaaauggcaguugauaugcagacacuaacaccaguaggaagauuaauaacugcaaacccgguaauaaccgaaaguacagaaaauucaaaaaugauguuggagcuggauccaccauuuggggacucauacauaguaauuggcguaggagaaaagaaaauuacacaccacuggcaucgaaguggaagcacaauaggaaaagcauucgaagccacaguaaggggagcaaaaagaauggcaguauuaggugacacagcaugggacuucgguucaguaggaggugcuuuaaauaguuuagguaaaggaauacaccaaauauuuggagcagcauuuaaaucauuauuuggaggaaugaguugguuuucacaaauucugauaggaacguuacuaauguggcuuggcuuaaauacgaaaaauggaagcauuucauuaauguguuuagcgcuugguggaguuuuaauauuuuuaucuacugcaguuagcgcg

SEQ ID NO: 2561 - RNA, 2067 nt, Artificial Sequence
  ZIKV prME variant CDS opt
gcagauacgucugucggaauaguuggauuacuacuaacaacugcaauggccgcagaagugacuagacgagguucggcguacuacauguaucuagacagaaaugaugcuggagaagccauaucauuuccaacuacauuaggaaugaauaaaugcuacauacaaauuauggaccuaggacauaugugugacgcaacaaugucauaugaauguccaauguuagaugaagggguagaaccagacgacguagauugcugguguaacacaacaucuacaugggugguuuacgguacaugucaucauaagaaaggugaagcaagacgcucaagacgagcaguaacacugccaucacauaguacaagaaaacuacaaacaagaucacaaacauggcucgaaucgagagaauacacaaaacaucuuauaagaguagaaaauuggauauucagaaaucccggcuucgcacuagcugcagcagcaauagcaugguuacuuggaaguucuacgagucaaaaaguaauauaucuaguaaugauacuucuaaucgcgccugcauauagcauaagguguaucggggucucaaauagagacuuuguagaaggaaugucaggaggaacauggguagauauuguguuagaacaugguggaugugucacaguaauggcacaagacaaacccacaguagacauagaauuaguuacuaccacaguaucaaacauggcagaaguucgaucguauuguuaugaagcauccauaagugauauggcaucagacaguagaugcccuacccaaggagaagcauauuuagauaaacaaagcgauacucaauacguauguaaaagaacccuaguagaucguggaugggguaacggaugugguuuauuugguaaaggcaguuuaguaacuugugcaaaguuugcauguucaaagaaaaugacagguaaaucuauacaaccggaaaaccuagaauaucgaauaaugcuaaguguacauggaucucagcauaguggaaugauaguaaaugacacagggcaugaaacagaugaaaacagagcgaaaguagaaauaacuccaaacagcccaagagcagaagcaacauuaggaggauuuggcagucuaggacuagauugugaaccaagaacuggauuagauuuuucagaucuuuacuacuuaacuaugaacaacaaacauugguuaguacacaaagaaugguuucaugacauaccgcuaccauggcacgcuggugcagauaccggcacaccucauuggaauaauaaagaagccuuaguagaauuuaaagacgcacaugcaaaaagacaaacaguaguaguacuaggaucacaggaaggagcaguacauacagcccuagcuggagcauuagaagcggaaauggacggagcuaaaggaagauugucaagcggacacuuaaaaugucgacuaaaaauggauaaacuaagacuuaaaggaguaucauauagcuuaugcacagcagcauuuacauuuacaaaaauaccggcagaaaccuugcaugggacuguaacaguagaaguacaauaugcagggacagauggcccauguaaaguaccagcacaaauggcaguagauaugcaaacccuaacuccaguaggaagauuaauaaccgcaaauccaguaauaacugaaagcacggaaaacucaaaaaugaugcuagaacuagauccaccauucggagacaguuauauaguaauaggcguaggagaaaagaaaauaacgcaccauuggcauagaagcggaaguacaaucggaaaagcauuugaagcaacaguaagaggcgcaaaaagaauggcaguacuaggagauacagcaugggacuuuggaucgguaggaggggcauuaaacaguuuagggaaaggaauacaucaaauauuuggagcagcauuuaaaucacuauucggaggaaugagcugguucucacaaauauuaauagggacauuauugauguggcuaggccuuaacacuaaaaauggaucaauaagucuaauguguuuggcauuaggcggaguacuaauauuuuuaucaacagcaguaucagca

SEQ ID NO: 2562 - RNA, 2064 nt, Artificial Sequence
  ZIKV prME variant CDS opt
gauaccucaguuggaauaguaggacugcuauuaacaacagcuauggcugccgaaguaacaagaagaggaagcgcauacuauauguacuuagauagaaaugaugcgggagaagcaauaaguuuuccaaccacacuaggaaugaauaaauguuacauacaaauaauggaucuagggcauaugugugaugcgacaaugucauaugaauguccaauguuggaugaaggcguagaacccgaugauguagacuguugguguaacacaacaagcacauggguaguauauggaacaugucaucacaagaaaggagaagcacgaagaaguaggagagcaguuacauuaccaucacauaguacuagaaaauugcaaacuagaucacaaacaugguuagaaagccgcgaauauacaaaacauuugauaagaguagaaaauuggauuuuuagaaacccaggcuucgcacuagccgcagcagcaaucgcauggcuucuaggaagcucuaccucacaaaaaguaauauauuugguaaugauauuauuaauagcaccagcuuauaguauaagauguaucggaguaaguaauagagauuuuguagaaggaaugaguggaggaacauggguagacauagucuuagaacauggaggauguguuacaguaauggcgcaagauaaaccaacaguagauauagaauuaguaaccacaacaguaaguaauauggcagaaguaagaaguuauuguuaugaagcaagcauuagugauauggcaucagauagucgauguccaacacagggagaagcauacuuggacaaacaaagugacacucaguauguauguaagagaacauugguagauagaggaugggguaaugguuguggauuauucggaaaaggaucguuggucaccugugcaaaauuugcuuguagcaagaaaaugaccggaaaaucaauucagccagaaaacuuagaauauagaauaauguuaagcguucauggaagucaacauagcggcaugauaguaaaugauacaggacacgaaacagacgaaaacagagcaaaaguagaaauuacaccaaauaguccaagagcagaagcaacauuaggagguuuuggaucucuuggauuggauugugaaccaaggaccggacuggauuuuucagaccuauauuacuuaacaaugaauaauaaacauugguuaguacacaaagaaugguuucacgacauuccauuaccuuggcacgccggagcagauacugggacaccgcauuggaauaauaaagaagcauuaguagaauuuaaagacgcacacgcaaaacgacaaacaguaguuguucuaggaagucaagagggggcaguucauacagccuuagcaggggcacuagaggcagaaauggauggagcuaaaggaagacuaaguaguggacacuuaaaauguagauuaaaaauggacaaauuacgucucaagggagucuccuauagcuuguguacagcagcauuuacuuucacaaaaauaccagcagaaacuuuacauggaacaguaaccguagaaguacaauaugcaggaacagauggaccaugcaaaguaccagcacaaauggcagucgacaugcaaacacuaacaccaguagggagacuaaucacagcaaauccuguaauaacagaaucaacugaaaauagcaagaugauguuagaauuagauccaccauuuggagauucauacauaguaauuggaguaggugaaaagaagauaacacaucacuggcacagaaguggaucaaccauaggaaaggcuuuugaagcaaccguaagaggugcaaaacgaauggcuguuuuaggagacacagcaugggacuuugggucaguagguggagcauuaaauagucuaggaaaagguauucaucaaauauuuggagcagcuuuuaaaaguuuauucggaggaaugucaugguucagccaaauauugauaggaacuuuauuaauguggcuaggauugaauaccaaaaaugguaguauuagucuaaugugucuugcguuaggaggaguauuaauauuuuuaagcacagcaguaucagca

SEQ ID NO: 2563 - RNA, 2061 nt, Artificial Sequence
  ZIKV (strain ZikaSPH2015) Polyprotein(108-794) CDS opt
acaagcguaggaauaguuggauuauuacuaacaacagcaauggcagcugaaguaacuagaagaggaagcgcauauuauauguaccuagaucgaaacgacgcuggagaagcaauaucuuucccaacuacauuaggcaugaauaaaugcuauauacaaauaauggauuuaggacauaugugcgaugcaacaaugucauacgaaugucccauguuagacgaaggaguagaaccagaugauguagauuguuggugcaauacaacaucaacaugggucgucuauggcacaugucaucauaagaaaggugaagcacggagaagucgcagagcaguuacacuaccgucacauucaacaagaaaacuacaaacuagaucacaaaccugguuggaaaguagagaauauacaaaacaucuaauaaggguagaaaauuggauauucagaaaccccggauuugcuuuagcugcagcagcaauagcauggcuacuaggaaguagcacaucacaaaaaguaauauaucuaguaaugauacuacuaauagcgccagcguauaguauaagauguauaggaguaucuaaccgugauuuuguggaagggaugucagguggaacauggguagauauuguauuagaacauggaggauguguaacagucauggcgcaagacaaaccaacuguagauauagagcuaguaaccacaacuguaucaaauauggcagaaguuagauccuauugcuacgaagcaucgauuagcgauauggcaagugauuccagauguccaacccaaggagaggcuuacuuagauaaacaaagugauacacaauauguaugcaaaagaacauuagucgauagaggauggggaaauggaugcggguuauucggaaaaggaucuuuagugacaugugcaaaauuugcuuguucuaagaaaaugacaggcaaaucaauacaaccagaaaacuuagaauauagaauuauguuaucaguacacggaucacaacauagcggaaugauugucaaugauacaggacaugaaacagaugaaaauagagcaaaaguagaaauaacaccuaauucaccuagagcagaagcaacacuaggaggauucggaaguuuagguuuggauugcgaaccacgaacuggucuagauuuuucagauuuauacuauuugacaaugaauaauaaacauugguugguacauaaagaaugguuucaugacauaccacuaccuuggcaugcaggagcagacacuggaacaccacacuggaacaauaaagaagcacuugucgaguucaaagaugcacaugcuaaaagacaaacaguuguuguauuaggaagccaagaaggagcaguacauacagcauuagcaggggcguuagaagcagaaauggauggagcaaaaggcagacuuucuuccggacauuuaaaauguagauuaaaaauggauaaauuacgccuaaaaggugucucauacucauuauguacagcagcauuuaccuuuaccaaaauuccagcggaaacccuucauggaaccguaacaguugaaguucaauaugcuggcacagacggaccaugcaaaguaccugcacaaauggcaguagauaugcaaacucuaacuccaguugggagacuaauaacagccaauccaguuaucacagaaagcacagaaaauucaaagaugaugcucgaauuagauccgccauucggugacucuuauauaguuauaggaguaggugaaaagaaaauaacacaucauuggcaccguagcggaagcacuauuggaaaagcauuugaagcaacaguuagaggugcaaaaagaauggcaguacuaggagauaccgcaugggauuucggaagugucggcggagcacuaaauucauuagguaaagguauacaucaaauauuuggagcagcuuuuaaaagccuauuugguggaaugaguugguucucgcaaauauuaauaggaacccuuuuaauguggcuaggacuaaauacuaaaaauggaaguauaagccucaugugucuagcacuugggggaguauuaauauucuuauccacagcuguaucagca

SEQ ID NO: 2564 - RNA, 2061 nt, Artificial Sequence
  ZIKV prME variant CDS opt
acgucaguaggaauugucggauuauuauuaacuacagcaauggcagcagcuguaaccagaaggggaucagccuacuauauguauuuggaccgaaaugaugcuggugaagcaauaucauuuccaacuacauuagguaugaauaaaugcuauauacaaauaauggaucuuggacauaugugugaugcaaccaugaguuaugaauguccuauguuagaugaaggaguagaaccugaugacguagauugcugguguaacacaacuucaacauggguaguauauggaacaugccaucacaagaaaggagaagcaagacgaagccggagagcaguaacauuaccaagucacucaacgagaaaauuacaaacaagaucacaaacauggcuugaaaguagagaauacacuaaacauuuaauaagagucgaaaacuggauauuuagaaauccaggauuugcacuagcagcugcagccauugcaugguuauuaggaucaaguacaucucaaaaagucauuuacuuaguaaugauauuacucauagcuccugcauauucaaucagaugcauaggcguuucaaacagagauuucguagaaggaaugucagguggaacauggguagauaucguacuagaacacggaggaugcguuacaguaauggcacaggauaaaccaaccguagacauagaauuaguaacaacuacuguaaguaauauggccgaaguaagaucauauuguuaugaagccaguauuagcgauauggccagcgauagcagauguccaacgcaaggagaagcauacuuagauaaacaaagugauacucaauauguauguaaacgaacauuaguagaucgaggaugggguaacggaugcgguuuauuuggaaaaggaucauuaguaacaugcgcaaaauuugcaugcucuaagaaaaugacuggaaaaucaauacaaccagaaaaucuagaauacagaauaauguuaucgguacauggaagccaacauucaggaaugauaguaaacgacacuggacaugaaaccgacgaaaauagagccaaaguagaaauaacaccuaauuccccaagagcagaagcaacauuaggaggauucggaagccuaggacuagauugugaaccaagaacuggucuugacuucucagacuuauacuaccuaaccaugaacaacaaacacugguuaguacauaaagaaugguuccacgacauaccauuaccuuggcacgcuggagcagacacaggcacaccccacuggaauaauaaagaggcuuuaguugaguucaaagaugcucacgcuaaaagacaaacaguaguaguacuagguucacaagaaggugcaguacauacagcuuuagcaggagcacucgaagcagaaauggauggagcaaaaggaagauuaucaaguggacaucuaaagugcaggcuaaaaauggauaaguuaaggcuaaaaggaguaucauauucucuaugcacagcagcauuuacauucacaaaaauaccagcagaaaccuuacauggcaccguaacaguagaaguacaauaugcagguacagauggcccuuguaaagucccagcacaaauggccguagauaugcaaacauuaacaccagugggcagauuaauaacagcaaaccccguaauaacugaaaguacagaaaauaguaaaaugaugcuagaauuagauccuccauuuggcgauaguuauauaguaauaggaguaggagaaaagaaaauaacacaucacuggcaccgcagcggaaguacuauuggaaaagcauuugaagcaacuguaagaggagcaaaaagaauggcuguucuaggagacacagcuugggacuuugguucuguaggaggagcacuaaauaguuugggaaaaggcauacaucaaauuuuuggcgcugcauucaaaucacuauuuggaggaaugaguugguuuucacaaauucucauaggaacauuauuaauguggcuaggguuaaacacgaaaaauggaaguauaucauuaauguguuuagccuuagguggaguauuaaucuucuuaucuacagcaguaucugcu

SEQ ID NO: 2565 - RNA, 2073 nt, Artificial Sequence
  ZIKV prME variant CDS opt
cguggagcugauaccucaguugguauaguaggcuuacuauuaacaacagcaauggcugccgcuguuacuagaagaggaucagcauauuauauguacuuagauagaaaugaugcaggagaagcaaucucauuucccacuacuuuaggcaugaauaaauguuacauucaaauaauggauuuaggacauaugugugaugcaacaaugucauacgaaugcccaauguuagaugaaggcguagagcccgaugauguagauuguugguguaauacuacaucuacuuggguaguguauggaacaugucaucacaaaaaaggagaagcaagacgaagcagacgagcaguaacauugccaucucacucaacaagaaaauuacaaacaagaucacaaacauggcuagaaucuagagaauacacaaaacauuuaauaagaguagaaaauuggauauuuagaaauccaggauucgcguuggcggccgcagcgauagcaugguuauuaggaucaaguacaucacaaaaaguuaucuauuuaguaaugauccuacuaauagcaccagcguauaguauuagauguauaggcguaucaaauagagauuucguagaggggaugagugguggaacauggguagauauaguuuuagaacaugguggguguguaacgguaauggcucaagauaaaccaaccguagauauagaguuagucacaacuacagucagcaauauggccgaaguaagaucauacuguuaugaagcaucaaucucagauauggccagugacaguagauguccaacucaaggagaagcuuaucucgacaaacaaagugauacacaauauguauguaaaaggacacuaguggauagagguugggguaaugguuguggacucuuuggcaaagguagucuagucacgugcgcuaaauuugcuugcucaaaaaaaaugacgggaaaaagcauacaaccugaaaauuuagaauaccgaauaauguuaucaguucauggcagucaacauagcgggaugauaguuaacgauacaggacaugaaacagaugaaaauagagcaaaaguggaaauaacaccuaacucaccuagagcggaagccacguuaggaggauuuggaaguuuaggauuagauugcgaaccaaggacaggauuagauuucucagauuuauauuaucuaacuaugaauaacaaacacugguuaguacauaaagagugguuccacgauauuccacuaccauggcaugcuggggcagacacuggaacaccucauuggaauaauaaagaagcauuaguagaauucaaagacgcacaugcuaaaagacaaacuguagugguacuaggaagucaagaaggagcaguacauaccgcacuugcuggagcacuagaagcagaaauggauggugcaaaaggaagacuuucaaguggacaucuaaaauguagauuaaaaauggacaaauuaagauuaaaaggaguaucauacucauuauguacagcagccuuuacauucacaaaaauaccugcagaaacacuucauggaacaguaacaguagaaguacaauaugcuggaacugauggcccguguaaaguucccgcucaaauggcaguugauaugcaaacauuaaccccugucgggagauugauaacagcuaauccaguuauaacagaaucuacugaaaacucaaaaaugauguuagaauuagacccaccauucggagauagcuauauaguaaucgggguaggugaaaaaaaaauuacacaccauuggcacagaaguggaucuacaauaggaaaagcauuugaagccacuguuagaggagcaaaacgaauggcaguacuaggugacaccgcaugggauuuuggaucagucggcggugcauuaaacucacuaggaaaaggaauccaucaaauauuuggagcugcauuuaaaagccuauuugguggaaugucaugguuuagccaaauacuaauuggaacuuuauuaauguggcuaggauuaaauacaaaaaauggaucaauuagcuuaauguguuuagccuuaggaggaguuuuaauauucuuaagcacagcuguaagugca

SEQ ID NO: 2566 - RNA, 2097 nt, Artificial Sequence
  ZIKV prME variant CDS opt
agaggacuaucuagcagaaaaagaagaucacaugacguauuaaccguucaguucuuaauauuaggaauguuauuaaugacaggaggaguaacaagacguggcuccgcguauuauauguaccuagauagaaaugaugcaggagaagcaauuucauuuccuacaacuuuaggaaugaauaaaugcuauauacaaaucauggaccuaggacauaugugcgaugccacaaugagcuaugaauguccaauguuagaugaaggcguagaaccagaugacgucgauugcugguguaacacaacuucaaccuggguaguauauggaaccugucaucauaagaaaggagaagcaagacgaucaaggcgagcaguaacauuaccaucucacucaacaagaaaauuacagacaagaucacaaacauggcuagaaaguagagaauauacaaaacauuuaauaagagucgaaaauuggaucuuucguaauccugguuuugcacuagcugcagcugcuauagcuugguuauuaggcucaagcacaucacaaaaaguuauuuacuuaguaaugauauuacuaauagcaccagcuuacucaauaagauguauagguguuuccaacagagauuuuguagaagguaugucuggaggaacuuggguugauaucgucuuggagcaugguggauguguaacgguaauggcucaagauaaaccuacaguagauauagagcuaguuacgacaacaguuagcaauauggcugaaguccgaaguuauugcuacgaagcaagcauaagugauauggcaagugauucaagaugcccaacacaaggagaagcauaucuagauaaacaaagugacacacaauacguuuguaaaagaacucuuguagauagggguuggggcaauggaugugguuuauucggaaaaggaaguuuaguaacaugugcuaaauuugcuuguucuaagaaaaugacuggcaaaucaauucaaccagaaaauuuagaauacagaauaaugcuaucaguucaugguucacaacauucuggaaugauaguaaaugauacaggacaugaaacagaugaaaaucgugcuaaaguagaaauuacaccaaacucaccaagagcagaagcaacucuugguggauuuggcucauugggguuggauugcgaaccaagaacuggauuagauuucagugauuuguauuauuuaacuaugaauaauaaacacuggcuaguucauaaagagugguuccacgacauaccauuaccauggcacgcaggagcagauacaggaacaccacauuggaacaauaaagaagcacucguugaauuuaaagaugcacaugcaaaaagacaaaccgugguaguauugggaucucaagaaggagcaguucacacagcacuagcaggagcauuagaagccgaaauggacggagcaaaaggaagguuaucuucagggcaucuaaaauguagauuaaaaauggacaaacuaagauuaaaagggguaaguuauucacuauguacagcagcuuuuacauucacaaaaauaccugcagaaacacugcacgggacaguaacaguagaaguacaauaugcaggaacagaugguccauguaagguacccgcacaaauggcaguugacaugcaaacucuaacgccaguaggaagacuaaucacagcuaauccaguaauaacagaaucaacugaaaacucaaaaaugaugcuagagcucgauccaccuuucggagauucauacauugugauagguguuggagaaaagaaaauuacacaucauuggcauagaucaggaucaacuauaggaaaagcauuugaagccaccguaagaggagcaaaaagaauggcugugcuaggagauacugccugggauuuuggaaguguaggaggagcauuaaauucacuagggaaaggaauacaucaaauauuuggagcagcauuuaaaucacuauuuggugguaugagcugguuuucacaaauucuaauaggaacauuauuaaugugguuaggucuaaacacuaaaaacggaagcauaucuuuaaugugccuagcacuaggugggguacucauauuucuaagcacugcugugagugca

SEQ ID NO: 2567 - RNA, 2097 nt, Artificial Sequence
  ZIKV prME variant CDS opt
agaggguuaucaagucgaaaaaggagaucacaugauguuuuaacaguacaauuuuuaauuuugggcaugcuacuuaugacuggagcaguaacaaggagaggaagugccuauuauauguaucuugauagaaaugaugcaggagaagcaauuucauuuccaacaacauuaggaaugaauaaauguuauauacaaauaauggauuuaggacacaugugugaugcaacaaugucauacgaauguccaaugcuagaugaagguguggaaccugaugauguagauugcugguguaacacaacaagcacuuggguaguauacggaacaugucaccacaagaaaggggaagcaagaagaaguagaagggcaguuacccuaccaagccauucaacaagaaaauuacaaacaagaucacaaacauggcuagaaaguagagaauacacaaaacacuuaauaagaguagaaaacuggaucuuuagaaauccaggauucgcacuagcagcugcugcuauugcuuggcuauuaggaagcaguacuagccaaaagguaauauaucuuguuaugauauuacuaauagcaccagcauacucaauaaggugcauaggaguaucaaauagagauuuuguagaaggaauguccggagguacauggguggauauuguacuagaacauggcggcugcgucacagugauggcacaagacaaaccaacaguagauauagaauuaguuacaacaacagucucgaauauggcagaaguaagaaguuauuguuacgaagcaagcauaagugauauggcaagcgacagucggugcccuacucagggagaagcauauuuagauaaacaaucagauacccaauacguauguaaacgaacucuaguagacagaggguggggaaauggauguggacuauuugguaaaggaucacugguaacaugcgcaaaauuugcaugcaguaagaaaaugacaggcaaaaguauucaaccugaaaauuuggaauauagaauaaugcuuagcguacauggaucacaacacucaggaaugauagugaaugauacaggacacgaaacagaugaaaauagagcaaaaguagaaauaacaccuaauaguccuagagcggaagcaacacuaggaggauucggaucauugggucuugacugugaaccacgaacuggguuagauuuuucagaucuauauuauuuaacaaugaauaauaaacauugguuaguacacaaagagugguuccaugauauaccauugccauggcaugcaggagcggauacuggaacaccgcauuggaacaacaaagaagcacuuguagaauuuaaagaugcacaugcaaaaaggcaaacaguaguaguacuuggaucucaagaaggagcaguacauacugcuuuagcaggagcauuagaagcugaaauggauggagcaaaagguagacuaagcucgggacacuuaaaaugcagacuaaagauggauaaauuaagauuaaaaggugugucguacaguuuauguacagcugcauuuaccuuuacuaaaauaccagcagaaacauuacauggcacuguaacaguugaaguacaauaugcaggaaccgaugguccaugcaaaguaccagcucaaauggcaguagauaugcaaacgcuuacuccaguaggaagguuaauaacagcuaauccaguaauaacugaauccaccgaaaauagcaaaaugauguuagaauuagauccaccauuuggggauucauauauaguuauaggaguaggagaaaagaaaauaacucaccauuggcacagaucaggaaguacaauaggaaaagcguucgaagcaacaguaaggggagcaaaacgaauggcaguauuaggagacacagcaugggacuuugguucaguaggcggagcauugaauagcuuaggaaaaggaauacaccagauauuuggcgcagcuuucaagagcuuauuuggaggaaugucgugguuuagccaaauacuaauaggaacuuuauugauguggcuaggacugaacacuaaaaacggaaguauuucauuaauguguuuagcauuaggaggaguauuaaucuuuuuaucaacagcaguaagugcu

SEQ ID NO: 2568 - RNA, 2136 nt, Artificial Sequence
  KU321639.1 prME-long CDS opt
cguauaauaaaugcaagaaaagaaaagaaaagaagaggcgcagauacaagcguaggcauaguuggguuacuguuaacaacagcuauggcugcagaaguaacaagaagagguagcgcuuauuacauguauuuagacaggaaugacgcuggagaagcaauuagcuuuccaacaacuuuaggaaugaauaaauguuauauucaaauaauggaucuaggacacaugugcgacgcaaccaugaguuaugaauguccaaugcuagacgaaggaguagaacccgaugauguugauuguugguguaauacaacgucaaccuggguuguauauggcacaugucaucauaagaaaggagaagcaagaagaaguaggagagcaguaacacuaccuucacauucaacuagaaaacuacaaacucguagccaaacauggcuagaaucacgagaauauacaaaacaucugauaagaguagaaaauuggauuuuuagaaauccuggauuugcucuagcugcagccgcaauagcauggcuacuaggaucuaguacuagccaaaaagugauauacuuaguaaugauauuacuaauagcuccugccuacaguauacgcugcauaggaguaagcaauagggacuucguagagggaaugucaggaggcacauggguagauauaguacuagaacacggaggauguguaacaguaauggcccaggauaaaccaacuguagauauugagcuaguaacuacaacuguaucaaacauggcugaagucagaaguuacuguuacgaagcaaguauaagugauauggccucagauucacgauguccaacucaaggagaagccuaucuagauaaacaaucagauacucaauauguauguaaaagaacuuuaguagauagaggcuggggaaauggcuguggauuauuuggaaaaggcagcuuagucacaugcgcaaaauuugccugcagcaagaaaaugacgggaaaaucgauacaaccggaaaauuuagaauauagaauaauguuaucaguacacgggagccaacauucaggaaugauaguaaaugauacaggacacgaaacggaugaaaauagagccaaaguugaaauaacaccuaacaguccaagagcagaagcuacacuagguggauucggcucauuaggauuggauugugaaccacgaacuggcuuagacuucucugacuuauacuacuuaacuaugaauaauaaacauuggcuaguacauaaagaaugguuccaugacaucccuuuaccauggcaugcaggagcagauacaggaacaccucauuggaauaauaaagaagcacuuguagaguucaaagaugcacaugcuaaaagacaaacaguaguaguauuaggaucacaagaaggugccguacacacugcgcuagcuggugcauuagaagcggaaauggauggagccaaaggaagacuaucuuccggacaucuuaaauguagauuaaaaauggauaaacuaagauuaaaaggaguaagcuauaguuuaugcacagcagcuuuuacauuuacaaaaauaccggcagaaacauuacauggaacaguaacaguugaaguucaauaugcgggaacggauggaccuugcaaagucccagcccaaauggcuguggacaugcaaacauuaacgccaguaggaagacucauuaccgcaaauccaguaauaacugaaucaacggaaaacaguaaaaugaugcuagaacuagacccuccauuuggagacagcuauauaguaauaggaguaggagaaaagaaaauaacacaucauuggcaucgaucuggaaguaccaucggaaaagcauuugaagcgacaguacgaggagccaaaagaauggccguauuaggcgauacagcuugggauuucgguucggucggaggcgcauuaaauaguuuaggaaaaggaauacaucaaauuuucggagcagcauucaaaagccuauuugggggcaugagcugguuuucacaaauacucaucgguacuuuauuaauguggcuaggacucaauacgaaaaaugguaguaucucauuaauguguuuagcauuaggcggaguauugauuuuucuuaguacagcaguaagugccgacguaggaugcucaguagauuucaguaaa

SEQ ID NO: 2569 - RNA, 2136 nt, Artificial Sequence
  KU312312.1 prME-long CDS opt
agaauuauaaacgcuagaaaagagaaaaagcguagaggagcugauacaagcguugggauaguagguuuguuacuaacaacagcaauggcagcagaaguuacaagaagagggagugcauauuacauguaucuagacaggaacgaugcuggugaagcaauuucauucccaacaacauuaggaaugaauaaauguuauauacaaauaauggacuuaggacacacaugcgaugcaacaaugucauaugaguguccgauguuagaugagggaguagaaccagaugacguagauuguugguguaauacaacaaguacaugggucguguauggaacaugccaccauaagaaaggagaagcaagaagaaguagacgagcaguaacauuaccaagucacaguacaagaaaacuacaaacuagaagucaaacaugguuagaaucuagagaguauacaaaacacuuaaucagaguagaaaauuggauauuuagaaauccaggauuugcauuagcagcugcggcaauagcuuggcuauuaggaagcucaacaucucaaaaaguaauauauuuaguaaugauacuauuaauagcaccagcuuauagcauaagguguauuggaguaucaaauagagauuucguugaaggaaugucaggaggaacauggguagauguuguucuagaacauggagguugcguuacagucauggcacaagauaaaccaacaguagauauagaauuagucacaacaacaguuaguaacauggcagaaguacgcucauauuguuaugaagcaagcauaagcgauauggcaucagauucaagauguccaacacaaggagaagcauauuuagauaaacaaucugacacacaauauguauguaaacguacguuaguagaccguggaugggggaacggauguggauuauuugguaaaggaucguuaguaacaugcgcaaaauucgcaugcaguaagaaaaugaccggaaaaagcauacaacccgagaacuuagaauauagaauaauguuaagcguacauggcagccaacauaguggaaugaucgucaacgauacaggacaugaaacagaugaaaauagagcuaaaguagaaauaaccccaaacagcccaagagcagaagcaacauuagguggauuugguucacuaggauuagauugcgaaccuagaacgggccuggauuuuagugaccuauacuauuuaacaaugaauaauaaacacugguuaguucauaaagaaugguuucaugauauuccucuaccauggcaugcaggcgcagauacagguacaccacacuggaacaauaaagaagcauuaguagaguucaaagaugcacacgcaaagagacaaacugucgugguacuagguagucaagaaggugcaguucauacagcacucgcaggagcguuagaagcagaaauggauggagcgaaaggaagauugaguucaggucaucuaaaaugccgacuaaaaauggauaaauuaagguuaaaagguguaucauauucauuaugcacagccgcuuucacauuuacaaaaaucccagcagaaacuuuacauggaacaguaacuguagaagugcaauaugccggaaccgauggaccaugcaaagucccugcucaaauggcuguagacaugcaaacauuaacgccaguuggaagacuaauaacagcaaaccccguaauaacggaaagcaccgaaaacagcaaaaugaugcuagaauuagauccaccuuuuggagacaguuauaucguuauaggcguaggcgaaaagaaaauuacccaucauuggcauagaaguggaagcacaauuggcaaagcauucgaggcaacaguaagaggcgccaaaagaauggcugucuuaggagacacagcaugggauuuuggaagugucggaggagcauuaaauagccuuggaaaaggaauacaucaaauauuuggggcagcauucaaaucacuauuuggaggaaugagcugguuuucacaaauuuuaauagguacccuauuaaugugguuaggacuaaaugcuaaaaauggaaguauaaguuuaaugugucuugcauuaggaggaguauuaauauuucuaucaacggcuguaucagcugauguaggauguaguguagacuuuucaaaa

SEQ ID NO: 2570 - RNA, 2124 nt, Artificial Sequence
  AY632535.2 prME-long CDS opt
agaauaaucaacgcucgaaaagaacgaaaaagaagaggagcagauacuaguauuggcauaauaggucuauuacuuacuaccgcuauggcagcugaaauaacaagaagaggaagcgcauacuacauguauuuagauagaagugaugcaggaaaagcaauuucuuuugcaacgacauugggaguaaauaaaugccacguucaaauaauggaucuaggacauaugugugaugcuacuaugucauacgaauguccgauguuagaugaaggaguagaaccagacgacgucgauuguugguguaauacaaccagcacauggguaguguacggaacaugccaccauaaaaaaggagaggcaagacgaagcaggcgagcaguaacauugccgagucacucaacaagaaaacuacaaacuaggucacaaacaugguuagaaaguagagaauauacaaaacauuuaauaaaaguggaaaauuggauauuuagaaauccaggauucgcucuaguugcuguggcaauagcuugguuauuagguaguaguacuagucaaaaagucauauaucuaguuaugauucuacugauagcaccagccuauucuauaagauguauaggaguaucuaacagagacuuuguagaagguaugucgggaggaacuuggguagauguaguacuagaacauggagguuguguaacggucauggcacaagauaaaccuacuguagacauagaauuaguaacaaccaccguaucgaacauggcagaaguaagaucuuauugcuaugaagcaaguauuagcgauauggcaagcgacucaagaugcccuacucaaggagaagcauacuuagacaaacaguccgauacucaauauguguguaaaagaacuuuaguagauagaggauggggaaacggcuguggacuauuuggcaaaggaucauuagugacaugugcaaaauuuacauguagcaaaaagaugacagguaaaaguauacaaccagaaaauuuagaauacagaauaauguuaaguguacauggcucucaacauagcggaaugauaggauaugaaacagaugaggauagagcaaaaguagaaguaacaccuaauaguccucgugcagaagcaacucuggguggauucggaagccuaggauuggauugugaaccacgaacaggauuagauuuuagugaucuauauuacuuaacaaugaauaauaaacauuggcuaguccauaaagaaugguuucaugacauuccauuaccauggcacgcaggugcagauaccggaacaccacacuggaauaauaaagaagcuuuaguagaauuuaaagacgcgcaugcaaagaggcaaacggugguaguauugggaucacaagagggagcaguacauacagcucuagcaggagcacuugaagcagagauggacggugcaaaaggaagauuauuuucaggacacuuaaaauguagacucaaaauggauaaauuaagguuaaaaggagucagcuauagcuuaugcacagcagcauuuacauucacaaaaguaccagcagagacauuacaugggacaguuacaguugaaguacaauaugcgggaacagauggaccauguaaaauacccgugcaaauggcaguugacaugcaaacauuaacaccuguaggaagauuaauuacagcgaacccaguaauaacagaaucuacagaaaauaguaaaaugauguuagaacuagacccaccauuuggagauaguuauauagugauaggagugggugauaaaaaaaucacacaucacuggcauaggaguggaucuacuauuggaaaagcuuuugaagcaacaguaagaggagcaaaaagaauggcaguuuuaggagauacagcaugggauuucggaagcguaggagggguauuuaauagccuagggaaagguauucaucaaauauuuggagccgcauuuaaaagucuauucgguggaaugaguugguucucacagauauuaauaggaacauuauuagucugguuaggauuaaauacaaaaaaugggucaauaucucugacaugucuagcacuagguggaguaaugauauuucuaaguacagcaguaagcgcagaugucggauguagcguagacuuuucgaaa

SEQ ID NO: 2571 - RNA, 2136 nt, Artificial Sequence
  KU527068.1 prME-long CDS opt
agaauaauaaaugcgagaaaggaaaaaaaacgacgaggagcagauacaucaguuggaauaguaggcuuauuauuaacaacggcaauggccgcagaagugacaagaagaggaagugcauauuacauguauuuagauagaaacgaugcuggagaagcuauaucuuuuccaaccacauuaggaaugaauaaauguuacauacaaauaauggauuuaggucauaugugugaugcuacaaugucauaugaguguccaauguuagaugaagguguagaaccugaugacguagauuguuggugcaacacaacaaguacauggguaguauauggaacaugucaucauaaaaaaggagaagccagaagaagcagacgugcuguaacauuacccucacauagcacaagaaaacuacaaacccgaagucaaacgugguuagaaucuagagaauacacaaaacaucuuauaagaguagagaauuggauauuuagaaauccugguuucgcauuggcagcagcagcaauugcguggcuacuaggaucgucuacaagucaaaaaguaauauacuuaguaaugauauuacuuauagcgccugcauauaguauaagauguauaggaguaagcaauagagauuuuguagaagguaugucaggggguacguggguagauguaguauuagaacaugguggaugcgucacaguaauggcacaagacaaaccuacaguagauauugaacuaguaacaacaacaguaucaaauauggccgaaguaagaucauauuguuaugaagcaucuauaagugauauggcuagugacaguagauguccaacacaaggugaagcauaucuagauaaacaaagcgauacacaauauguguguaaaagaacauuaguagauagaggaugggguaacggaugugguuuauuuggaaaaggauccuuaguaacgugugcaaaauuugcuuguagcaaaaaaaugacaggaaaaucaauccaaccagaaaauuuagaauauagaaucauguuguccgugcaugguagucaacacucuggaaugauuguaaaugauacaggacaugaaaccgaugaaaauagagcaaaaguugaaauaacaccgaauagcccaagggcagaagccacauuaggaggauuuggcucguuaggucuagauugugaaccaagaaccggauuagauuuuagugaccuauauuaucuaacuaugaacaacaaacacugguuaguucacaaagaaugguuucacgauauacccuuacccuggcaugcuggggcagacacagguacaccacauuggaauaauaaagaagcacuuguagaauucaaagacgcucaugccaagagacaaacuguaguugugcucgguagucaggaaggugcuguacacacagcacuugcaggagcacuugaagcagaaauggauggagcaaaggguagauuaucuaguggucauuuaaaauguagauuaaaaauggacaaauuaagauuaaaaggcguaaguuauucacuauguacugcagcauuuacauuuaccaaaauaccagcagaaacacuacauggaacugucacaguagaaguacaguaugccggaacagaugguccauguaaagugccggcucaaauggcaguugauaugcaaacauuaacaccaguaggaagauuaauaacagcaaauccgguuauuacagagucuacggaaaauucgaaaaugaugcuugaacuagacccaccauucggugacaguuacauugucauugguguaggugaaaaaaaaauaacacaccauuggcauagaucaggaaguacaauaggaaaagcauuugaagcuacagugagaggagcgaaacgaauggcaguacucggugauacagcaugggauuuuggaucuguagguggagcauuaaauaguuuaggaaaagguauacaucaaauauuuggagcagcuuuuaaaucacuauuuggaggaaugucaugguuuucucaaauucucauagguacacuauuaauguggcuaggccuaaauacaaaaaacggaagcauaaguuuaauguguuuagcuuuaggagguguuuuaauuuuuuuaaguacagcgguaucagcagauguaggauguucaguugauuuuucaaaa

SEQ ID NO: 2572 - RNA, 2136 nt, Artificial Sequence
  KU720415.1 prME-long CDS opt
agaauaauaaaugcaagaaaagagcgaaaacguagaggagcagauacaagcauuggaaucauagguuuacuauugacaacagcaauggcugcugaaauaacuagaagaggcuccgccuauuauauguaccuagacaggucagacgcagguaaagccauaagcuuugcaacaacauuaggcguaaauaaaugucauguacaaauaauggauuuaggacauaugugugacgcuacaaugaguuaugaauguccaauguuagaugaaggaguggaaccagacgauguugauuguugguguaauaccacuaguacauggguaguauaugguacgugucaccacaaaaaaggcgaagcaagaagauccagaagagcggucacauuaccaucacauucaacuagaaaacuacaaacaagaucccaaacauggcuugaaagcagagaguacacuaaacaccuaauaaaaguagaaaauuggauauucagaaacccuggauuugcauugguagcaguagcaauagcaugguuauuaggaaguagcaccucacaaaaaguaauauaucuaguaaugauucuacuaauugcaccagcauauucaauaagaugcauagguguuuccaauagagauuuuguagaaggaaugucaggaggaacauggguagacgucguccuagaacacggugggugcguaacuguaauggcacaggauaaaccaacuguagauauagaauuaguaacaacaacuguaucuaauauggcagaaguaagaucauauuguuacgaagcaucaauaucugauauggcaagugauuccagaugcccaacacaaggagaagcauauuuagauaaacaaucagauacacaauauguuuguaaaagaacccuggucgaucgagguugggguaauggauguggucuuuuugguaaaggaagccuaguaacaugugcaaaauuuacauguagcaaaaaaaugacaggaaaaucuauacaaccagaaaaucuugaauauagaauaauguuaaguguucauggaagccaacauucaggcaugauagugaaugauacagguuaugaaacagaugaaaacagggcgaaaguagaaguaacaccaaacucaccacgagcagaagccacuuuaggaggauucggaucauuaggacuagacugugagccaagaacaggauuggauuuuagugaucuauacuauuuaacaaugaauaauaaacacugguuaguacacaaagaaugguuccaugacauaccauuaccuuggcacgccggagcagacacaggaacaccccacuggaauaauaaagaagcgcuaguagaauuuaaagaugcacacgccaaaagacaaacugucguaguauuaggaucacaagaaggugcaguacauacagcucucgcaggagcauuagaagcagaaauggacggagccaaagguaaacuuuuuucaggacauuuaaaauguagauuaaaaauggauaaauugcgacuaaaagguguaagcuauucacuauguacagcagcauuuacauucacaaaaguacccgcagaaacacuacauggaaccgugacaguagaaguucaauaugcaggaacagauggcccauguaaaauaccuguacaaauggcaguagauaugcaaacacuaacucccgucggcagauuaauuacagcaaauccaguaauaacugaaaguacagaaaauucaaaaaugaugcuagaauuagauccgccauucggagauucauacauaguuauuggcgugggagacaaaaaaauuacacaucacuggcauagaagcggaaguaccauaggaaaagcuuuugaagcaacaguucgaggagcaaaaagaauggcaguauuaggugacacugccugggauuucgguuccguaggaggaguuuucaauucauuaggcaaagguauucaccaaauauuuggugcggcauucaaaucauuauuuggagguaugucaugguuuagucaaauacuaauaggaacauuacuaguaugguuaggauuaaauacaaaaaacggguccauaucuuuaacauguuuagcucuagguggcguuaugauauuuuuaaguacugcaguaagugcagauguuggcugcucagucgauuuuucuaag

SEQ ID NO: 2573 - RNA, 2118 nt, Artificial Sequence
  DQ859059.1 prME-long CDS opt
agaauaauaaaugcaagaaaagaaagaaaaagaagaggggcugauacaaguauagguauaguaggacugcuauuaacaacggcaauggcugcagaaauaacaaggaggggaucagcauauuacauguaucuagauagaucugaugcgggaaaagcaauaucuuuugcgacaacuuuaggaguaaauaaaugccauguacagauaauggauuuaggacauaugugcgaugcgacuaugaguuaugaaugcccaauguuagacgaagggguugaaccagacgacgucgauuguugguguaauacaacgaguacuuggguaguauauggaacaugccaucacaagaaaggcgaagcaagaagaagcagacgagcgguaacauuaccaucacauucaacaagaaaacuacaaacaaggucacaaacauggcuagaaagcagagaauauacaaaacauuuaaucaaaguagaaaauuggaucuucagaaauccagguuuuacucuaguagccgucgcaauugcaugguuauuaggaaguaguacaucacaaaaaguaauauauuuaguaaugauacuauuaauagcgccagcauauaguaucagauguauaggaguaagcaauagagauuuuguagaaggaaugucaggagguacauggguagacgugguacuugaacauggagguuguguuacuguaauggcacaagauaagccgacuguagauauagaauuaguuacaacaacuguaaguaauauggcagaaguucgaaguuauuguuacgaagcaucgauaagugauauggcaucagacucaagauguccuacacaaggugaagcauaucuagacaaacaaucagauacacaauacguauguaaaagaacauuaguagaucguggguggggaaauggaugcggauuguuuggaaaaggaagccuaguaacaugcgcuaaauuuaccuguaguaaaaagaugacuggaaaaucaauucagccggaaaaccuagaauacagaauaaugcuaucaguacacggaagucagcauucagguaugaucguaaaugacgaaaauagagcuaaaguagaagugacgccuaacaguccaagagcagaagcuacgcuaggagguuuugggagucucggauuagauugugaaccuagaacaggauuggauuuuagcgauuuauacuacuuaacuaugaauaauaaacauuggcuuguacauaaggaaugguuucaugacauaccauuaccauggcaugcaggagcagauacagguacaccccauuggaauaauaaagaagcucuaguugaguucaaggaugcacaugcuaaaagacaaacagucguaguauuggggucacaagaaggugcaguacauacagcucuugcuggagcacuagaagcugaaauggauggagcuaaaggaagacuguuuaguggucauuuaaaaugucgauuaaaaauggacaaauuaagauugaaagggguaagcuacucuuuauguacugcagcauucacguucacuaaaguaccggcugaaacauuacauggaacaguaacaguagaaguacaauaugcggguacagauggaccauguaaaguaccagcucaaauggcgguagauaugcaaacacuaacaccaguugggagauugauaacagcgaacccaguaauaacggaaaguacagaaaauaguaaaaugauguuggaacuugacccaccauucggagauaguuauauaguuaucggaguaggagauaagaaaauuacacaucauuggcauagaaguggaaguacaauugggaaagcauuugaagccacuguuagaggggcaaaaaggauggcaguuuuaggagauacagcaugggacuuuggaagcguaggcgguguuuuuaauagucuagguaaagggauacaucaaauauuuggugcagcauucaaaaguuuauuuggagggaugucaugguucagucaaauucuaauugguacacuauuaguaugguuaggucuaaauacgaaaaauggaaguauuucauugacaugucuugcauuagguggaguaaugauuuuccuaaguacagcuguuagugcagaugugggauguaguguagauuuuucaaaa

SEQ ID NO: 2574 - RNA, 2136 nt, Artificial Sequence
  KX377335.1 prME-long CDS opt
agaauaauaaacgcuagaaaagaaagaaaaagaagaggagcagauacauccauaggaauaauaggauuacuucucacaacagcgauggcagcagaaaucacaagacgcggaagugcauacuauauguaucuagauagauccgaugcaggaaaggcgauaucauuugcaacgacauuaggcguuaauaaaugucauguacaaauuauggauuugggccacaugugugaugcuaccaugaguuacgaauguccuaugcuagaugaaggaguagaaccugaugauguggauuguuggugcaacacaacaucaacaugggugguuuaugguacuugccacagaaagaaaggugaagcaagaagaagcagacgagcaguaacacuuccaucccauucaacacggaaacuacaaacaagaucacaaacaugguuagaaucuagagaauacacaaaacaucuuauaaaaguagaaaauuggauuuuuagaaacccaggauuugcauuaguagcuguugcuauagcauggcuucuagguucaucaacaucacaaaaaguaauuuauuuaguuaugauauuauuaauagcuccagcauauaguauuagauguauuggaguaucgaauagagauuuuguugaagguaugaguggaggcacauggguggacgucguauuagaacacgggggauguguaacaguaauggcacaagacaaaccaacaguugacauagagcuaguaacuacaacaguaaguaacauggcagaaguaagaagcuauuguuaugaagccaguaucagugacauggcaagugacaguagauguccuacacaaggagaggcuuauuuagauaaacaaagugauacacaguauguauguaaaagaacauuaguagauagagguuggggaaauggcuguggacucuuuggaaaaggaucgcuaguaacaugugcaaaauuuacauguucaaagaaaaugacuggaaaaucaauucaaccagaaaacuuggaauaccgaauaaugcuaagcgugcauggaucccaacauagcgggaugauaguaaacgauacaggauaugaaacugacgaaaacagagcaaaaguagaaguaacuccaaauaguccaagagcagaagcaaccuuaggaggauuugguucuuuaggacuagauugcgaacccagaacaggauuagacuuuagugaccuuuauuauuuaaccaugaauaacaaacauuggcuaguucauaaagaaugguuucaugauauaccauuaccauggcaugcaggcgcagauacuggcacuccacauuggaacaauaaagaagcgcuaguagaauuuaaagacgcucaugccaagagacaaacaguggucguacuuggaagccaagaaggcgcagugcauacagcucuagcaggagcacuagaagcagaaauggauggugcaaaaggaaaguuauuuaguggacauuuaaaauguagacuaaaaauggauaaauuaagauuaaaaggagucagcuacucgcucugcaccgcagcauuuacauuuacaaaaguaccagcagaaacauuacauggaacaguuacaguugaaguacaauaugcagguacagauggaccauguaaaauaccaguucaaauggcuguagacaugcaaacauuaacgccuguagggagacuaauaacagcaaauccagucauaacggaaucaacagaaaacaguaaaaugaugcuagaacucgacccuccauucggagacucauacauaguaauuggaguuggagacaagaaaauuacucaccauuggcacagaucagggucaacaauaggaaaagccuucgaagcaacuguaagaggagcuaaaagaauggcuguauuaggcgacacagcaugggauuuuggauccgucggaggaguauuuaauagcuuaggaaaaggaauacaccaaauauuuggagcggcuuuuaaaucacuuuuuggcggaaugucaugguuuucacaaauacuuauaggaacucuauuaguaugguuaggccuaaauacuaaaaauggaaguauaucauuaacaugucuagcauuaggaggagucaugauauucuuaagcacagcaguaagugccgacguaggaugcucaguagauuuuaguaaa

SEQ ID NO: 2575 - RNA, 2136 nt, Artificial Sequence
  LC002520.1 prME-long CDS opt
agaauaauaaaugcaagaaaagaaagaaaaaggagaggugccgauacgucuauagguauaauaggauuauuacuaacuacagcaauggcggcagaaauaacacgaagaggaagugcguacuacauguaucuagacagaagugacgcaggaaaagcaauuagcuucgcaacaacacuugguguaaauaaaugucauguccaaauaauggauuuaggacauaugugugaugccacaaugucauaugaauguccaaugcuagaugaaggaguggagcccgaugacguugacuguugguguaauacaacaagcacuuggguaguauaugguacuugccaucauaagaaaggugaagccagaagaagcagacgagcaguuacauuaccaucacacagcacuagaaaauuacaaacaaggagucagacuugguuagaaagucgagaauacacaaaacaccuaauuaaaguagaaaauuggauauuuagaaacccuggcuucgcauuaguagcaguugcaauagcauggcuacuagguaguaguacaagucagaaaguaauuuauuuagucaugauccuauugauagcaccagcauauucaauaagauguauugggguuucaaauagagauuucguagaggggaugaguggcggaacauggguagacguaguauuagaacauggaggcuguguuacgguaauggcgcaagauaaaccaacugucgauauagagcuaguaacaacaacaguaucaaauauggcagagguaagaucuuacuguuaugaggcaaguauaagugauauggcaucagacaguagauguccuacacaaggagaagcauauuuagauaaacaaucggauacacaauauguauguaaaaggacgcuaguagaucgaggauggggaaacggauguggauuauucggaaaaggaaguuuaguuacaugcgcaaaauucacauguucaaagaagaugacaggaaaaucaauacaaccagaaaaccuagaauacagaauaauguuaucuguacacggaagucagcauucaggaaugacaguaaaugacauaggauacgagacugaugaaaauagagcuaaaguagaaguaacuccaaauucaccgagagcagaagcuacauuaggaggauuuggaagucuaggacuagacugugaaccucgaacagguuuagauuuuagugauuuauauuacuuaacaaugaacaacaaacacuggcuaguucauaaagaaugguuucaugacauaccauuacccuggcacgcuggugccgauacaggaaccccacauuggaacaauaaagaagcauuaguagaauuuaaagaugcacaugcaaaaagacaaacaguaguagucuuggguucacaagaaggcgccguacauacggcauuagcaggggcuuuagaagcagagauggauggcgcaaaagguaaauuauuuucgggacaccuaaaaugcagauuaaaaauggauaaauuacgauuaaaaggaguaucauauucacuauguacagcagcauuuacauuuacaaaaguaccagcugaaacucugcacggaacagugacgguagaaguucaauacgccgguacagauggaccaugcaaaauaccuguacaaauggcuguagauaugcaaaccuuaacaccaguaggaagauuaauuacugcaaauccaguaauuacagagagcaccgagaauagcaaaaugaugcuagaauuagauccaccuuuuggugauucauauauaguaaucgguguuggagauaagaaaauaacacaccacuggcauagaucaggaucaacaauagguaaagcauucgaagcaacaguaagaggcgcaaaacgaauggcuguacuaggugauacagcuugggauuuuggaucaguaggaggaguauuuaacagucuaggaaaaggaauacaucagauuuuuggggcagcauucaaaaguuuauuuggaggcaugagcugguucagucaaauauuaauuggaacacuuuuaguauggcuaggauuaaauacgaaaaaugguaguauaagucugacaugucuagcauuaggugguguaaugauauuucuuagcacagcggucagcgcagauguaggauguucuguggacuuuaguaaa

SEQ ID NO: 2576 - RNA, 2124 nt, Artificial Sequence
  KU963573.2 prME-long CDS opt
cgcauaauaaaugccagaaaagaaagaaaaaggagaggugcagauacauccauaggaauaauaggacuguugcuaacgaccgcaauggcagcagaaauuacaaggaggggcucagcauauuauauguaucuagauaggucugaugcaggaaaagcaauaaguuuugcaacaacacuagggguaaauaaaugccauguucaaauaauggauuuaggacauaugugugaugcaacaaugaguuacgaaugcccuaugcuagacgaaggaguggaaccggacgacgucgauugcugguguaauacaacuucaacauggguuguauaugguacuugccaucauaaaaaaggagaagcaagaagaagccgaagagcaguaacacuaccaagccauagcacucgaaaauugcaaacaagaucucagacauggcuagaaucaagagaauauacaaaacauuuaaucaaaguagaaaauuggauauuuagaaauccaggauucgcccuaguagcaguggcaauagcaugguuauuaggaucuucaacaagucaaaaagucauauauuuagugaugauuuugcuaauagcuccagcauauucuauaagauguauaggaguaucaaacagagacuuuguugaaggaaugaguggcggaacauggguagauguaguauuagaacauggaggaugugugacaguaauggcucaagauaaaccaacuguugauauugaacuuguaacaacaacaguaucuaacauggcugaaguaagaaguuauuguuaugaggcuucuauaucagauauggccucagauaguaggugcccuacacaaggagaagcauacuuagauaaacaaagugacacacaauacguauguaaacgaacuuuaguagauagagguuggggaaauggcuguggucuauuuggaaaaggaagucuaguaacaugugcaaaauuuacauguucaaaaaaaaugacuggaaaaucaauucaaccagaaaauuuagaguauagaauaaugcuaucaguacauggaagucaacacagugggaugauaggauacgaaacagacgaaaauagggccaaaguagaaguaacaccgaacucuccaagagcggaagcgacauuagggggauucggaucauuaggauuagauugugaaccaagaacaggauuagauuuuagcgaucuauauuacuuaacaaugaauaacaaacauuggcuaguacauaaagaaugguuucaugauauaccucuaccauggcaugcaggagcagauacugguacgccacauuggaacaauaaagaagcauugguagaauuuaaagaugcacaugcuaagaggcaaacgguuguaguacucggaucacaagaaggagcaguacauacugccuuagcuggugcacuagaagcagaaauggauggugcaaaaggaaaacuauuuaguggacauuuaaaaugucgacuaaaaauggacaaacuaagacuaaaaggaguuucauauucuuuaugcacagccgcauuuacauucacaaaagucccagcagaaacacuucacggaacagugacaguugaaguacaauaugcaggaacggauggaccguguaaaauaccuguacaaauggcaguagauaugcaaacacuaacaccaguaggaagauugauaacagcaaacccaguaauaacagaaucaacagaaaacucaaaaaugauguuagaguuggauccgccauucggagauaguuauauuguuauaggaguaggcgacaagaaaauaacucaucauuggcauagaucaggaagcacuauagguaaagcguucgaggcaacggugagaggggcuaaaagaauggcaguauuaggagauacagcaugggauuuuggaaguguaggaggaguauucaacucacuaggaaaaggaauacaucaaauauuuggagcagcuuuuaaaucacuauucgguggcaugagcugguuuucacaaauauuaauaggcacacuauuaguaugguuaggacuaaacacaaaaaauggaaguauaagucuaacauguuuagcacuaggaggaguaaugauauuucuaucaacagcagugagugcugauguagguugcaguguugauuucucgaaa

SEQ ID NO: 2577 - RNA, 2136 nt, Artificial Sequence
  KX694534.2 prME-long CDS opt
agaauaauaaaugcaagaaaagaaaagaaaagacguggagcugauacaucaguaggaauaguaggauuacuauuaacaacugcgauggccgcagagguaacacgaagaggaucagccuacuauauguaucuggacagaaaugaugcaggagaagcaauaaguuuuccaacuacauuagguaugaauaaauguuauauacaaauuauggacuuaggacauaugugcgaugcuacaaugucauacgaaugcccaauguuagaugaagguguagaacccgacgauguugauuguugguguaacacaacaaguacauggguaguuuacgggaccugucaccauaagaaaggagaagcgagaagaucaaggagagcagucacucugccaagccacucuacaagaaaauugcaaacaagaagucaaacauggcuagaaaguagggaauacacaaaacauuuaaucagaguagaaaacuggauauuuaggaauccaggcuuugcacuagcagcagcagcaaucgcuugguugcuagguagcaguacaagucagaaaguaauauauuuaguaaugauuuuauuaauagcaccagccuauucaauucgauguauaggugucagcaauagagauuuuguagaaggaaugucuggcggaacauggguugauguaguacuugaacauggaggaugugugacaguaauggcucaagacaaaccaacuguagacauagaauuaguaaccacuacuguaaguaauauggcagaaguaagaaguuauuguuaugaggcuucaauaucagauauggcaucagacucaagauguccaacacaaggagaagcauaucuugacaaacaaucagauacgcaauauguauguaaaagaacucuagucgauagaggaugggguaacggauguggauuauucggaaaagguagcuugguaacuugugcaaaauuugcauguaguaagaaaaugacagggaaaaguauacaacccgaaaaucuagaauaucgaauaauguuaagugugcauggaucgcaacauaguggaaugauaguaaaugauacaggacaugaaacagaugaaaauagagcuaaaguagaaauaacaccaaauucaccgagagcagaagcaaccuuaggaggguuuggaaguuugggauuagauugugaacccagaacaggcuuagacuuuucagaucuauauuaccuaacuaugaacaauaaacauugguuaguacauaaagaaugguuucaugauauaccuuuaccauggcaugcaggagcagauacugguacaccgcauuggaauaauaaagaagcauuagucgaauuuaaggaugcacacgcaaaaagacaaacaguaguaguacuaggaucucaggaaggcgcagugcauacagcacucgcuggugcauuagaagcagaaauggauggagcaaaaggaagauuaagcucgggacaucuaaaauguagauuaaaaauggacaaauugagauuaaaagguguaagcuacaguuuaugcacagccgccuucacauucacaaaaauaccugcagaaacauuacauggaaccguuacgguagaaguacaauacgcaggaacagauggaccauguaaagucccagcacaaauggcaguagauaugcaaacauuaacaccaguagguagauugauaacugcaaauccaguaauuacggaaucgacagaaaauaguaaaaugaugcuagaauuagauccaccauucggcgauaguuauauaguaauaggaguuggagagaaaaagauaacacaucacuggcaucgaagugguucaacaauaggcaaagcauucgaagcaacagucagaggagcaaaaagaauggcuguauuaggcgacacagcgugggacuucggaaguguagguggagcacuaaauucauuaggaagaggaauacaucaaauauuuggagcagcauuuaaaucacuauuuggagguaugagcugguuuagucaaauauuaauuggaacauuauuaaugugguuaggacuaaauacuaaaaaugguucuauaaguuuaauguguuuagcacuaggaggaguacuaauuuuucucaguacagcuguaucagcagauguugguuguucaguugauuucagcaaa

SEQ ID NO: 2578 - RNA, 2136 nt, Artificial Sequence
  KX447520.1 prME-long CDS opt
agaauaauaaacgcacgaaaagagaaaaagagaagaggcgcagaugccagcguaggaauaguaggauuacuacuaacaacugcaauggcagccgaagucacucgaagaggaagugcauauuauauguauuuagauaggaaugaugcaggggaagcaauaucauuccccacaacauuaggaaugaauaaaugcuacauacaaauaauggauuuaggacauaugugugacgcaacgaugucauacgaauguccuauguuagacgagggaguugaaccagaugacguagauugcuggugcaauacaacaucaacauggguuguauauggcacuugucaccauaagaaaggagaagcgagaagaucuaggagagcaguaacacuaccaucacauaguacgagaaaacuacaaacaagaucucaaacaugguuagaaucaagagaauauacaaaacacuuaauaagaguagaaaacuggauauucagaaacccaggauucgcauuagcagcagcagcaauugcgugguuacuaggaaguaguacaagccaaaaaguuauauaucuugucaugauucuauuaauagcaccagcauauaguauuaggugcauaggcguuagcaacagagauuucguagaagggaugucaggaggaacauggguagauguuguauuagagcaugggggaugugucaccguaauggcacaggauaaaccuacaguagacaucgaauuaguuacaacaacaguaucaaauauggcagaaguaagaucuuauugcuaugaagcaucaauaucagacauggcuagugauagccgaugcccuacacaaggagaagcauacuuagauaaacaaucagauacacaauauguauguaaaagaacccuaguagauagaggauggggaaauggauguggauuauucggaaaaggaucauugguaacuugugcaaaauuugcauguucaaagaaaaugacuggaaaaagcauacagccugaaaaucuugaauacagaauaaugcuuaguguacacggaucucaacauucagggaugauaguaaacgauacagggcaugaaacagaugaaaauagagcgaaaguagaaauuacaccuaauagucccagagcugaagcaacacuaggaggauucggaagccuaggacuugauugugaaccccguacaggauuagauuuuucagacuuauauuauuugacaaugaacaauaaacauuggcuaguccacaaagaaugguuccacgacauaccgcuacccuggcacgcaggagcggacacugguaccccacauuggaauaauaaagaagcauuaguagaguucaaagaugcacaugcuaaacgacaaacaguaguaguacuuggaagucaagaaggagcaguacauacagcauuagcgggugcacuagaagcagaaauggauggagcaaaaggaagauuaaguagugggcaucuaaaaugcagacucaaaauggauaaacuaagguuaaaaggaguaucauauucauuauguacagcagcuuuuacauuuacuaaaauaccugcagaaacguuacauggaacgguaacugucgaaguacaauaugcuggaaccgacggaccaugcaaaguaccugcacaaauggcaguagauaugcaaacauuaacuccuguaggcagauugauaacugcaaacccugucauaacggaaucaacagaaaauaguaaaaugaugcuugaauuagacccaccauuuggagauaguuauauaguaaucggaguaggggaaaagaaaauaacacaucacuggcacaggucggggucaacaauaggaaaagcguuugaagcaacaguaagaggagcaaaaaggauggcaguauuaggugacacagcuugggauuuuggaagcguagguggugcauuaaauaguuuaggaaaaggcauucaucaaaucuucggagcggcauuuaaaagucuauucggaggaaugucuugguuuucucaaauacuuauuggaacuuuauuaauguggcuaggauuaaauacuaaaaacgguaguauaaguuuaaugugccucgcauugggaggaguauuaauauuucucaguacagcgguaagcgcagacguaggguguagcguagauuucucuaaa

SEQ ID NO: 2579 - RNA, 2136 nt, Artificial Sequence
  KX369547.1 prME-long CDS opt
agaaucauaaaugcucggaaggaaaaaaaaagaagaggagccgauacaagcguaggaauaguaggauuacuucuaacgacagcgauggcggcagaggucacaaggagaggauccgcauauuacauguacuuggauagaaaugaugcaggagaagcaauaucauuuccaacaacacuaggaaugaacaaauguuauauacaaauaauggaucuaggacauaugugcgaugcuacaaugucauaugagugcccaauguuggaugaaggaguagagccagaugauguagacuguugguguaacacaacaucaacuuggguuguauacgggacgugucaucauaaaaaaggggaggcgaggaggucgagaagagcaguaacguuaccaucacauagcacaagaaaauuacaaacacgaagucaaaccuggcuagaaaguagagaauauacaaaacauuuaauuagaguagaaaauuggauauuuagaaacccaggauuagcguuagcugcagcagcaauagcauggcuuuuagguagcucgacaagucaaaaaguuauauaucucguuaugauacucuuaauagcaccugcauauaguauaagauguauuggaguaaguaaucgagacuuuguagaagguaugucaggaggaacaugggucgaugugguacuggaacauggaggauguguaacuguuauggcacaagauaaaccaacaguagacauagaguuaguaacaacaaccguaucaaacauggcagaagugcguaguuauugcuaugaagcgucgauaucagacauggcaagugauagccgauguccaacucaaggagaggcauauuuagauaaacaaagugauacucaauauguaugcaaaagaacacuagucgauagagguugggguaacggaugcggauuauucgggaaaggcucauuaguaacuugugcuaaauuugcuuguucaaaaaaaaugacuggaaaaagcauucaaccagagaauuuggaauaucguauaauguuaaguguucauggaucacaacacucagguaugauagucaaugauacaggacaugaaacagacgaaaauagggcaaaaguagaaauaacaccaaauaguccuagagcagaagcaacauuaggcggauuugggaguuuaggcuuagacugugagccaagaacuggauuagacuuuagcgacuuauauuacuuaacaaugaacaacaaacauugguuaguacacaaagagugguuucaugauauaccguuaccauggcaugcaggagcagacacuggaacaccacauuggaauaauaaagaggcauugguagaauuuaaagaugcccaugcgaaacgacaaacagugguaguacuaggaucacaagaaggcgcaguacauacagcacuugcuggcgccuuggaagcagaaauggacggggcuaaagguagauuaaguucaggucauuuaaaauguagauuaaaaauggacaaauuaagauuaaaaggugugucauauucauugugcacagcagcauucacauuuacuaaaauaccagcugaaacauuacacgguacaguaacaguagaaguucaauaugcagguacggacggcccauguaaagucccagcucaaauggcgguagauaugcagacauuaacuccaguugguagacuaauaacagcaaauccuguaaucaccgaaaguacugaaaauucaaaaaugauguuggaacuugauccaccauuuggagauucauauauuguaauagguguaggggaaaaaaaaauaacacaucauuggcacagaaguggaaguacgauuggaaaagccuuugaagcaacgguaaggggugcaaaacgaauggcaguauuaggugauacagcaugggauuuuggcaguguaggaggugcacuaaauucauuaggaaaaggaauacaucaaauauucggagcagcauuuaaaagcuuguuuggugguaugucaugguuuucacaaauacuaauaggaacacuauuaaugugguuaggauuaaauacaaaaaaugggaguauaagucucaugugucuggcauuaggcggaguacucauauuuuuaaguacagcaguuagcgcagauguaggauguaguguagauuuuaguaaa

SEQ ID NO: 2580 - RNA, 2136 nt, Artificial Sequence
  KX447515.1 prME-long CDS opt
cgaauaauaaaugcacgaaaagaaaagaaaaggagaggagcugacacuuccguaggcauuguaggauuacucuuaacaacugcuauggcagcugaagucaccagaagagggucagcauauuacauguaucuugauagaaaugacgcaggggaagcaauuagcuuuccaacaacacuuggaaugaauaaauguuacauacaaauaauggaccucggacauaugugcgacgcaacuaugagcuaugaauguccaaugcuagacgaaggaguagaaccagaugacguagacuguuggugcaauacuacaaguacuuggguaguuuaugggacaugccaucauaagaaaggugaagcaagaagaucuaggagagcaguuacauuaccuagucauagcacgagaaaacuacaaacaagaucccaaacaugguuagaaucaagggaauacacaaaacaucuuauaagaguagaaaauuggauauucagaaaucccgguuucgcucuagcagcagcugcuauagcuuggcuauugggaaguagcacuagccaaaaaguaauauacuuaguaaugauacuauuaauagcuccugcauauucuauaagauguauuggaguaaguaacagagacuucguugaaggaaugaguggaggcacauggguagaugucguacuugaacacggaggauguguaacaguaauggcacaagauaaaccgacaguagauauugaauugguaacaacaacagucaguaauauggcagaaguuagaaguuauuguuaugaagcuaguauaagugacauggcaucagauucacgauguccuacacaaggagaggcuuaucuagacaaacagucugauacacaauacguguguaaaagaacuuuaguugaucgaggauggggaaauggauguggacuauuuggaaaaggaucauuaguaacaugugcaaaauucgcauguucaaagaaaaugacaggaaaaagcauacaaccagaaaauuuagaauacagaauaauguuaagugugcauggaucccaacacagcggcaugauaguaaaugauacaggacacgaaacagaugaaaacagagcaaaaguugaaauuacaccaaauaguccacgagcggaagccacacuuggaggguucggaucacuaggacuugacugugaaccaagaacuggauuagauuucucagauuuauauuacuuaacaaugaauaacaaacauugguugguacauaaagaaugguuucacgauauuccgcuaccauggcaugcuggagcagauacagggacaccacauuggaauaacaaagaagcucuaguagaauuuaaagaugcacaugcaaagagacaaacaguaguaguacuaggaagucaggaaggagcaguacauacagcacuagcaggagcucuagaagcugaaauggauggugcaaaaggaagacuaaguagcggacaucuaaaauguagacuaaaaauggacaaacuaagacuaaaggggguuucauauucauuauguacagcagcuuuuacauucacaaaaauaccugcagaaacuuuacaugguacaguaacaguugaaguacaauaugcuggaacagacggacccuguaaaguaccagcacaaauggcaguagauaugcaaacauuaacaccaguuggacgauuaauaacagcaaaucccguuauaaccgaaaguacagaaaauucuaaaaugauguuagaauuagaucccccauucggagacagcuauauagugauuggaguaggagaaaagaaaauuacacaucacugguaccgcucaggaucaacaauaggaaaagccuucgaagcuacuguaagaggugcaaaacgaauggcaguacuaggggacacagcgugggauuucgguucaguaggaggagcacuuaacuccuuagguaaaggcauacaucaaauauuuggagcagcuuuuaaaucucuauuugggggcaugucaugguucucacaaauuuuaaucggcacacuacuaaugugguuaggacuaaauacuaaaaacggaucaauaagucucaugugucuagcccuaggaggaguacuaauauuucuaaguacugcuguaucagccgaugugggaugcaguguagauuucagcaaa

SEQ ID NO: 2581 - RNA, 2136 nt, Artificial Sequence
  KU501217.1 prME-long CDS opt
agaauaauuaaugcacgaaaagaaaaaaaaagaagaggagcugauacaaguguaggcauaguagguuuacuguuaacuaccgcuauggcagcagaaguaacgagaagaggaucagcauauuauauguauuuagauagaaaugaugcuggggaagcaauaucauuuccuacaacauuaggaaugaauaaaugcuauauucaaauaauggaucugggacacaugugugaugcaacaaugucauaugaaugccccauguuagaugaagguguagaaccagaugauguagacuguugguguaauacaacaucaacuuggguaguauauggaacaugccaucauaaaaaaggagaagcgagaagaagcagaagagcuguaacauuaccaucacauaguacuagaaaacuacaaacaagaagccaaacauggcuugaaaguagggaauauacuaaacaucuuauaagaguagaaaauuggauauuuagaaauccaggauucgcauuagcagcugcagcuauagcauggcuauuaggaucauccacaagucaaaaaguaauauauuugguaaugauauuacuaauugcaccagcauacucaauaagauguauaggagucaguaauagagauuuuguggaaggaaugagcggaggaacauggguagacguaguuuuagaacacgguggaugcguuacaguuauggcacaagauaaaccaacuguagacauagaauuaguuacaaccacaguaaguaauauggcagagauuagaucauauuguuaugaagcauccauaagcgauauggcaucggauaguagauguccaacacagggcgaagcauaccuagauaaacaaagcgauacgcaauauguuuguaaaagaacgcuaguagauagaggaugggguaaugguuguggacuuuucggaaaaggaagccugguaaccugugcaaaauucgcauguucuaaaaaaaugacaggaaaaucuauucaaccagaaaaucuggaauauagaauaauguuaagcguccauggaagucaacauuccggaaugauuguaaaugauacgggacaugaaacagacgaaaacagagcaaaaguugaaauaacaccaaauuccccaagagcagaagcaacccuaggaggauuuggaucauuaggauuagauugcgaaccuagaacaggacuagacuucucagaccuguauuaccuaacaaugaacaauaaacauugguuaguacauaaagaaugguuccaugauauaccacuaccguggcaugcaggagcugacacuggaacaccccauuggaauaacaaagaagccuuaguagaguuuaaagaugcacacgcaaaacgacaaacaguagucguccuagguagucaagaaggugcuguacauacagcauuagcuggugcucuagaagcagaaauggauggagcuaaaggaagacuaucaaguggacaccuaaaaugccgauuaaaaauggauaaauuaagacuaaaaggaguaaguuacaguuuaugcacagcggcauuuacauuuacaaaaauacccgcagaaaccuuacaugguacaguaaccguagaaguacaauaugcaggcacggauggaccauguaaaguaccagcacaaauggcuguugauaugcaaacacuaacaccgguaggccgauuaauaacugcuaacccaguaaucacagaaaguacugaaaauaguaagaugauguuagaauuggacccaccauuuggagacucauauauaguaaucggcguaggagaaaaaaaaauuacacaucacuggcauagaucaggaaguacaauaggaaaagccuucgaagcaacuguaagaggagcaaagagaauggcaguacuaggagauacagcaugggauuuuggaucgguuggaggagcucucaauagcuugggaaaaggcauacaucaaauauuuggagcagccuuuaaaaguuuguucggaggaaugaguugguuuucucaaauauuaaucgggacacuacuaauguggcugggauuaaauacaaaaaauggcucaauaagucucaugugcuuagcuuuagggggcguuuuaauauuuuuaaguacagcaguaucagcagacguugguugcagcguagauuuuagcaaa

SEQ ID NO: 2582 - RNA, 2136 nt, Artificial Sequence
  KU312314.1 prME-long CDS opt
agaauaauaaaugcccgaaaagaaaaaaaacgaagaggagccgacacaaguguaggaaucguaggguuauuacuuacgacggcuauggcggcagaaguaacacgaagaggaagugccuacuacauguacuuggacagaaaugacgcaggagaagcaauaucauuuccaacaacacuagguaugaacaaauguuauauucaaaucauggaucuaggucauaugugugaugccacuaugagcuacgaaugcccaaugcuugaugagggcguagaaccugaugauguggacuguuggugcaacacaacuaguacuugggucguguacggcacaugucaucauaaaaaaggagaagcaagaagaagcaggagagcaguaacguuaccgagccauucaacaagaaaacuacaaacaagaagccaaacaugguuagagagucgagaauauacaaaacacuugauaagaguagaaaacuggauauuuagaaauccagguuucgcauuagcagcagcagcaauugcauggcuauuggguaguuccacaagucaaaaaguaauuuauuuaguuaugauauuauuaauagcucccgcauacucaauaagaugcauaggaguaagcaauagagauuuuguagagggaauguccggaggaacguggguagauguagucuuagaacaugguggauguguaacuguaauggcacaagauaaaccaacuguagauaucgaacuuguaaccacaaccguaucaaauauggcagaaguuagaucguacugcuaugaggccucaauaucagauauggcaucagauucaagauguccaacacaaggugaagcauaucuugacaaacaaucugauacucaauauguauguaaaaggacacuaguagauagagguugggguaauggcuguggacuauuugguaaaggaucucuaguaacaugugcaaaauuugcauguucaaaaaaaaugacaggaaaaaguauacaaccagaaaaucuagaauacagaauaauguuauccguacaugggagccaacauagcggaaugauaguaaaugauacuggacacgaaacagaugaaaaucgagcaaaaguagaaauaacucccaauucaccuagagcugaagcaacccuaggagguuuuggaaguuuaggauuagauugugaaccacgaacaggucuagauuuuucagaucuauauuauuuaacaaugaauaacaaacacugguuaguacauaaagaaugguuucaugauauaccauuaccauggcacgcaggggcagacacaggaacuccccacuggaacaacaaagaagcuuuaguggaauuuaaagaugcacaugcaaaaagacaaacaguaguaguacuaggcucucaagaaggagcugugcauacugcauuagcaggagccuuagaagcagaaauggauggagcaaaagggagauugucaucagggcauuuaaaaugucgacuaaaaauggauaaauuaagauuaaaaggggucagcuauucacuauguacggcagcuuuuacauuuacaaaaauaccagcagaaacacuccaugguacaguaacaguagaaguucaauaugcagguacagauggaccauguaagguucuagcacaaauggcaguagauaugcaaacguuaacuccuguaggaagauuaauaacagccaauccuguaauaacagaaucaaccgaaaauucaaaaaugauguuagaauuagauccuccuuuuggagauucuuauauaguaauagguguuggugaaaaaaaaauaacacaucauuggcauagaaguggaagcacaauagguaaagcauuugaagcaacaguaagaggagcaaaacgaauggcuguacuaggagacacagcuugggauuucggaaguguaggcggagcauuaaauucauuaggaaaggguauacaucaaaucuuuggggcugcauucaaaaguuuauuugguggaaugagcugguucucacaaauucuuaucggaacacuauuaauguggcuaggucuuaauacaaaaaaugggucaauaucuuuaauguguuuagcauuagggggaguacuuauauuccucucaacagccguaucagcagacguuggauguucaguagauuuuucaaaa

SEQ ID NO: 2583 - RNA, 2136 nt, Artificial Sequence
  KX446950.2 prME-long CDS opt
agaauaauaaaugccagaaaagaaaaaaaaagacguggugcugacaccaguguaggaauaguaggauuauuguuaacaacugcaauggcggcagaaguaacaagaaggggaagugcauauuauauguaucuagauagaaacgacgcaggcgaagcaauaaguuucccaacaacauuaggaaugaacaaauguuauauacaaauaauggaccucgggcacaugugcgaugcaacaaugaguuaugaaugcccaacacuagacgaaggaguugaaccggaugacguagauuguuggugcaacacaacaaguacguggguuguauaugguacgugucaucauaaaaaaggugaagccaggaggucaagaagggcaguaacauugccaucccauaguacacggaaauugcaaacaagaucacagacuuggcuugaaagcagagaauauacaaaacauuuaauaagaguagaaaauuggauauuucggaauccaggauuugcauuagcagcugcugcaauugcauggcuucuagguucgucaacaucacaaaaaguaauauauuugguaaugauauuguuaauugcuccagcauauucaauucguuguauagguguaagcaaucgugauuucguagaaggaaugagcggagggacguggguugaugucguguuagaacauggaggguguguaacaguaauggcacaagauaaaccaacaguagauauagaauuaguaacaacuacaguaagcaacauggcagaaguaagaucauauuguuaugaagcaaguauauccgacauggccuccgauaguagaugucccacacaaggugaagcguauuuagauaagcaaucugauacacaauacguaugcaaaagaacacuaguagauagagguuggggaaauggcugcggauuauuuggaaaaggcagucuaguuacaugcgcaaaauuugcauguagcaaaaaaaugacaggaaaaaguauucaaccagaaaacuuagaguauaggauaauguuaucgguacacggaagucaacacucaggaaugauuguaaacgacacgggccacgaaacugacgaaaauagagcaaaaguagaaaucacgccaaauucaccacgagccgaagccacauuaggaggauuuggaucacugggauuagauugcgaaccuagaacgggauuggauuuuagugauuuauauuauuuaacuaugaauaauaaacauugguuaguacauaaagagugguuucaugauauaccucuaccuuggcaugccggggcagauacuggaacuccacauuggaauaauaaagaagcauuaguagaauuuaaagaugcccacgcaaaaagacaaacaguaguuguauuaggaagucaggaaggagcuguacauacagccuuagcaggagcacuagaagcagaaauggauggagcaaaaggaagauuaucaaguggacacuuaaaauguagauuaaaaauggacaaacuaagacuuaaaggugugucauacuccuuauguacagccgcuuuuacuuuuacuaaaauuccagcggagacuuuacaugggacuguaacaguagaaguucaguaugcagguacagaugguccaugcaaaguaccagcccaaauggcaguugauaugcaaacauuaacaccaguaggaagauuaaucacagccaaucccguaaucacagaauccacagaaaauaguaagaugaugcuagaauuagacccaccguuuggagauaguuauauaguaauaggaguuggggaaaagaaaauaacacaucauuggcaccgaagcgguagcaccauaggaaaagcuuuugaagcaacaguuagaggagcuaaaagaauggcaguauugggugauacagcaugggauuucggaucaguagguggagcauuaaacagcuuggguaaaggaauacaucaaauuuucggagcagcauuuaaaagcuuauuuggaggaaugaguugguucucacaaauauuaauaggaacacuauuaaugugguuaggacuaaauacaaaaaauggaaguauaaguuuaauguguuuagcauuagggggaguacuaauauucuuaucaacagcaguaucugcugacguaggaugcucaguagauuuuagcaaa

SEQ ID NO: 2584 - RNA, 2136 nt, Artificial Sequence
  KY003157.1 prME-long CDS opt
aggauaauaaaugccagaaaagaaaagaaaaggagaggagcagacacaagcguaggaauaguaggcuuauuauuaacaacagcaauggccgcagagguaacucgaagaggaucagcguacuauauguauuuagauagaaaugaugcaggagaagcaauaucauuuccaacaacauuaggaaugaacaaaugcuacauacaaauaauggauuuagggcauaugugugaugccacuaugaguuaugaaugcccaaugcuagacgaggguguggaaccagaugacguagauuguugguguaacacaacaucuacauggguuguauauggaacuugucaucacaagaaaggagaagcacgaagaagcaggagggcaguaacacuaccaagccauucaacuagaaaacuccaaacaagaagucaaaccugguuagaaucaagagaauauacgaaacaucuaauaagaguagaaaacuggauauuuagaaaucccggauuugcauuagcagcagcagcaaucgccuggcuauuaggaaguucaacaagucaaaaagugauauaucuagucaugauacuacuaauugcaccagcuuauagcauaagauguaucggugucagcaauagagacuucguugaagguaugucagguggaacguggguagacguuguuuuagaacacggcggauguguaacaguaauggcacaagauaaaccaacgguagacauagaacuugugacaacuacuguuaguaacauggcagaaguacgaagcuauugcuaugaagcaucuauaucagauauggcaucagauucacgauguccuacacaaggagaagcauacuuagauaaacaaagcgauacacaauauguuuguaaaaggacauuaguagauagaggcuggggaaaugguuguggauuauuuggaaaagguucauugguaacgugugcaaaauucgcuuguagcaagaaaaugacagguaaaucaauacaaccugaaaacuuggaauacagaauuaugcuaucaguacauggaucacaacauuccggaaugauaguaaaugauacuggucaugaaacagaugaaaaccgagccaaaguagaaauaacaccuaauucuccaagagcagaagcuacauuaggaggauucggaucacuuggucuagauugcgaaccaagaacuggacuugacuuuagugauuuauacuauuuaacaaugaauaauaaacauuggcuaguacauaaagaaugguuucaugacauaccauuaccauggcacgcaggagcagauaccggaacaccacacuggaacaauaaagaagcucuaguagaguucaaagaugcucaugcaaaaagacagaccgugguaguauuaggaucacaagaaggagcuguacauacggcucuagcaggagcacuugaagcggaaauggauggugcaaaaggacgauuaaguucagggcaucuaaaauguagauuaaaaauggacaaauuaagauuaaaaggaguaaguuauaguuuaugcacagccgcuuuuacauuuacuaaaauaccagcagaaacguuacauggaaccguuaccguagaaguacaauaugcaggaacagaugguccaugcaagguaccagcacaaauggcaguagauaugcaaacgcuaacaccaguaggaagguuaaucaccgcuaauccagugauaacagaaucgaccgaaaauuccaaaaugauguuagaauuggauccaccuuuuggagacuccuauauaguaauagggguuggggaaaagaaaauaacccaccauuggcauagaucagggucaacaauaggaaaggcuuucgaggcaaccgugcgaggagcaaaaagaauggcgguuuuaggggauacugcaugggauuuuggaagugugggaggagcauuaaacagccuggguaaagguauacaucaaauauucggagcagcauucaaaucauuauuuggaggaaugagcugguuuagucagauacuaauuggaacauuacugauguggcuuggauuaaacaccaaaaacggaucaauuagcuuaaugugcuuagcacuugguggaguauuaauauuccuaaguacaguaguuucagcagauguagguugcucaguagacuucagcaaa

SEQ ID NO: 2585 - RNA, 2136 nt, Artificial Sequence
  KX811222.1 prME-long CDS opt
agaauuauaaaugccagaaaagaaaaaaaaagaagaggcgccgauacaucaguagggauaguaggauugcuauuaacaacagccauggcagcagaaguuacaagacgaggaucagcauauuacauguacuuagauagaaaugaugcaggagaagcuauaaguuucccgacuacuuuaggaaugaacaaguguuauauucaaauuauggacuuaggacacaugugugacgcaacaaugucauaugaaugcccaauguuagacgaaggaguagaaccagaugauguagauuguugguguaacacuacaagcgcuugggucgucuacgggacaugccaccacaaaaaaggagaagcuagacgaaguagaagagcaguaacccuaccaucucauaguacacgaaaacuacaaacuagaccucaaaccugguuagaaucaagagaauacacaaaacauuuaauacgaguagaaaauuggauauucagaaacccaggauucgcguuggcagcggcggcaauugcaugguuauuaggaucaaguacaucucaaaaagucauauauuugguuaugauacuuuuaauagcuccagcauauagcauacgauguauaggaguaagcaauagagacuuuguggaaggaaugucaggagggacauggguugacguagucuuagaacauggaggauguguaacggucauggcacaagauaaaccaacaguugauauagaauuaguaacaacaacaguaucaaauauggcagaaguuagaucauauuguuaugaagcaucaaucucagacauggcaagugacucaagaugucccacgcaaggugaagcauaucuagacaaacaaagugauacacaauauguaugcaaaagaacacuuguagacagaggauggggcaacggaugcggucucuuugguaagggcagcuuaguuacaugugcaaaauucgcguguaguaaaaaaaugacagguaaaucaauacagccugaaaaucuugaauaucgaauuauguuaucuguucacggaucacaacauucuggcaugauuguaaaugacacaggucacgaaacagaugaaaacagagcuaaaguagaaauaacaccgaacucaccaagagcagaagcuacuuuaggagguuuugggaguuuaggacuagauugcgaaccaagaacaggacuugauuuuagugauuuauacuauuuaaccaugaauaauaaacauuggcugguacauaaagaaugguuucaugauauuccauuaccauggcaugcaggagcugauacaggaacaccccacuggaauaauaaagaagcgcuuguagaauuuaaagacgcacaugccaaaagacaaacaguaguaguuuuagguagucaagaaggggcaguccauacagcacuagcgggagcauuagaagcagaaauggauggagcaaaaggacgauuaagcucaggacaucuaaaauguagacugaaaauggauaaauuaaggcuaaaaggaguaagcuauagucuuugcacagcagcauucacuuuuacaaaaauuccagcggaaacacuacauggaacuguaacaguagaagugcaauacgcaggaacugauggaccguguaaaguuccagcacaaauggcaguagauaugcaaacauuaacaccaguaggacguuuaauaacagccaauccaguaauaacagaaucaaccgaaaacucgaaaaugaugcuagaauuagauccuccuuuuggagauucguacauaguuauaggugucggagaaaaaaagaucacacaucacuggcauagaagcggcaguacaauaggaaaagcauuugaagcuaccguacguggagcuaaaagaauggcaguucuaggcgauacugcaugggauuuuggcucaguuggaggugcauuaaacagcuuagggaaaggaauacaucaaauuuuuggugcagcauucaaaagcuuguuuggaggaaugucaugguuuagccaaauauuaauuggaacuuuacuuaugugguuaggacuaaauacaaaaaaugguaguauaucauuaaugugucuugcauuagguggaguauugauuuuuuuaucaacagcaguaagcgcagauguaggauguucaguagacuuuuccaaa

SEQ ID NO: 2586 - RNA, 2136 nt, Artificial Sequence
  KX447516.1 prME-long CDS opt
agaauaauaaaugcacgaaaagagaaaaagagacgaggcgcagacacaaguguaggaauaguaggccuacuuuuaacuacagcaauggcugcagaaguaacgagacgagguuccgcauauuauauguaccuugacaggaaugacgcaggggaagcaauauccuuuccaaccacauuaggaaugaauaaauguuacauacaaauaauggaucuaggacauaugugugaugcaacaaugaguuaugaauguccaaugcuggaugaaggaguagaacccgaugacguagauuguuggugcaauacuacaucaacauggguaguauaugggaccugucaucauaaaaaaggagaagcaagaaggaguagaagagcagucacauugccgagucacucaacaagaaaauuacaaacaagaucccaaacauggcuugaaucuagagaauacacaaaacaucuuauaagaguugaaaauuggauuuucagaaaccccggauucgcgcuagcagcagcagcaauagcauggcuccuuggaucauccacaaguaaaaaaguaauauacuuagugaugauauuacuaaucgcaccagcauacaguauacguugcauaggaguaucaaaucgagauuucguugaagggaugucuggagguacauggguagauguuguacuagaacaugguggauguguuacaguaauggcgcaagacaaaccuacagucgauauagaacuaguaacaacuacaguaagcaauauggcagaaguccgaucauacuguuacgaagcaaguauaucugacauggcaagcgacagucgauguccaacacaaggagaagcauaucuagauaaacaaucugacacacaauauguuugcaaaagaaccuuaguugauagaggaugggguaauggguguggcuuauuuggcaaggguagucuuguaaccugugcaaaauucgcauguaguaaaaaaaugacaggaaaaagcauacaaccagaaaaucuagaauauagaauaauguuaucaguacaugguagucaacauucaggaaugauaguuaaugacaccggacacgaaacugaugaaaaucgagcaaaaguagaaauaacaccaaauaguccacgagcagaagcuacauuaggcggauuuggaucguuaggauuagauugugaaccaagaacuggauuagauuuuagugaucuauauuaccuaacaaugaauaauaaacacugguuaguacauaaagaaugguuucacgacauaccacuacccuggcacgcuggagccgauacuggaacaccacauuggaacaacaaagaagcacuaguagaguuuaaagaugcacacgcaaaaagacaaacaguaguaguauuaggaucacaagaaggcgcaguccauacagcacuagcaggagcauuagaagcggagauggacggagcaaaaggaagacuaaguucaggccauuuaaaaugcaggcuaaaaauggauaaauuaagauuaaaaggaguaucauauucacuauguaccgccgcauuuacauuuacaaaaauaccagcagaaacuuuacauggcaccguuacugucgaaguccaauaugcuggaacagauggaccauguaagguuccagcucaaauggcaguggauaugcaaacacuaacuccaguagguagacuaauaacagcaaauccgguaauuacugaaucaacagaaaacucaaaaaugaugcuagaauuagauccuccguucggagacucguacauaguuauagguguaggugaaaaaaaaauaacacaucauuggcauagaucaggaucaaccauagggaaagcuuuugaggcuacgguaagaggagcaaaacgaauggccguuuuaggagauacugcaugggauuuuggaagcguaggaggagcauuaaacucauuaggaaaaggaauacaucaaauauuuggagcagcauuuaaaagucuauuuggaggaaugucaugguuuucacaaauacuaauaggaacucuguuaaugugguuaggacuaaauacaaaaaauggaucuauaagccuuaugugccuagcucuaggaggaguuuuaauauucuuaaguacagcuguaucagcagauguuggauguucuguagacuucucuaaa

SEQ ID NO: 2587 - RNA, 2136 nt, Artificial Sequence
  KX520666.1 prME-long CDS opt
agaauuauaaaugcacgaaaagaaaagaaaagaagaggcgcugauacaagcgugggaauugugggauuauuauuaacaacagcaauggcagcggaaguuacaagaagaggaagugccuauuauauguaucuagauagaaaugacgcaggagaggcaaucucauuuccaacuacacuuggaaugaauaaauguuacauccaaauaauggacuuaggacauaugugcgaugcaacuaugucauacgaauguccgauguuagaugaaggaguagagccagacgauguagauugcugguguaauacaacuucaacauggguaguauacggcacgugucaucauaagaaaggcgaagcuagacgauccaggagagcaguaacauuaccuucacauaguacaagaaaauuacagacaagaucacaaacaugguuagaaucuagagaauauacaaaacaucuaauuagaguugaaaacuggauauuuagaaacccaggauucgcacuagcagcugcagcaauagcaugguuacuaggcagcucuacgagacaaaaaguaauauaccuuguuaugauacuccuaauagcaccagccuauucaauuagaugcauaggaguaaguaacagagauuuuguugaaggaaugagcggagguacauggguagauguaguauuagaacauggaggaugugugacaguaauggcacaggauaaaccaacuguagacauagaauuaguaacaacaacuguaagcaauauggcagaaguaagaaguuacuguuaugaagccucaaucagcgauauggcaagugauucaagauguccaacacaaggugaggcuuauuuagauaaacaaagcgacacacaauauguaugcaaaaggacauuaguagacagaggauggggaaacgguugcggccuauucggaaaaggaagucuaguuacaugugcaaaauuugcuuguucuaagaaaaugacaggaaaaagcauacagcccgaaaaccuagaauaucgcauaauguuaagcguacauggaucacaacauaguggaaugauaguuaaugauacaggacacgaaacagaugaaaacagagcaaaaguggaaauaacuccaaauucacccagagcagaagcaacacuaggaggauucggaucacuaggacuagauugugaaccgaggaccggauuggauuuuagugauuuguacuauuugacuaugaauaacaaacauuggcuaguacacaaagaaugguuucaugauauaccauuaccauggcaugcaggagcagauacggguacaccacauuggaauaacaaagaagcauuaguagaauuuaaagacgcacaugcaaaacgacaaacaguaguaguacuugggagucaggaaggagcaguacauacagcauuagcaggagcauuagaagcagaaauggauggugcaaaagguagacuuucauccggacaccugaaaugucgacuaaaaauggauaaauuaagauuaaaaggggugagcuacagcuuguguacugcagcauuuacuuuuacuaaaauaccagcugaaacacuucauggaacaguaacuguagaagugcaguaugcaggaacagaugguccauguaaaguaccagcacagauggcuguagauaugcaaacucuaacaccuguuggcaggcuaauaacugcaaauccaguaauaacagaaucaacagaaaacucaaaaaugauguuggaauuagauccaccauuuggagauaguuacauaguaauagguguuggggaaaagaaaauuacucaucauuggcacagaucaggaucuacgauaggaaaagcauuugaagcuacuguaagaggcgcaaaaaggauggcaguauuaggugauacggcaugggacuuuggaucuguagguggagcguugaauagucuagguaaaggaauacaucaaauauuuggagcagcauuuaaaucauuauuugguggcaugaguugguuuagucagauacuuauaggaacucuauuaaugugguuaggauuaaacaccaaaaauggaucaauaucacuuauguguuuagcauuagggggaguccuaaucuuccuaucaacagcaguaagcgcggauguaggauguucaguagauuuuagcaaa

SEQ ID NO: 2588 - RNA, 2136 nt, Artificial Sequence
  KU729218.1 prME-long CDS opt
cguauuauaaaugcaagaaaagaaaagaaaagaagaucagcagauacaucaguugguauugugggcuuacuucucacaacagcgauggcagccgaaguaacuagaagaggaucagcuuacuacauguauuuagacaggaaugacgcuggggaagcuauaucauuuccuacaacauuaggaaugaauaaaugcuauauacaaauaauggaccuuggacacaugugugaugcaaccaugagcuaugaauguccaauguuagacgaaggaguagagccagaugauguagacuguuggugcaauacuacuuccaccugggugguauauggaacaugccaccauaagaaaggugaagcaagaagaaguagacgagcaguaacacugccaucacacaguacaagaaaacuucaaacaagaagccaaacauggcuagaaaguagagaauauacaaaacauuuaauaagaguagaaaacuggauauuuagaaauccuggauuugcuuuagcugcugcagcaauagcauggcuauugggaagcaguacaagccaaaaagucauauaccuaguaaugauacuucuuauagcaccagcauauucaauaagauguauaggaguaucaaauagagauuuugucgaaggcaugaguggaggaacauggguagauguuguuuuagaacauggaggauguguaacaguaauggcacaagauaaaccaacaguagacauagaauuaguaacaacaacagucucaaacauggcagaaguaagaucauauuguuacgaagcaucaauuucagauauggcuucagauucaagauguccuacacaaggagaagccuaccuagauaaacaaagugacacucaauacguaugcaaaagaacucuaguagauagagguuggggaaacggauguggguuauuuggaaaaggaagccucguaacaugugcaaaauucgccugcaguaagaaaaugacaggaaaaagcauacaaccagaaaacuuagaauauagaauaaugcuuaguguacacgguucucaacauucaggaaugauaguaaacgauacaggccaugaaacagaugaaaacagagcgaaaguagaaauaacaccaaauucacccagagcagaagccacacuuggaggauuuggcucauuaggauuagauugugaaccacgaacaggacuagacuuuagugaucuauauuacuuaaccaugaauaacaaacacuggcuaguacauaaagagugguuucacgauauuccacucccauggcacgcaggagcagauacuggaacaccgcauuggaauaauaaagaagcccucguagaauuuaaagaugcacaugcuaaaaggcaaacggugguaguauuaggaagucaagaaggagccguacacacagcauuggcaggggcacuagaggcugaaauggacggagcaaaaggucgauuaucaaguggacauuuaaaauguagauuaaaaauggauaaauuaaggcuaaaaggaguaucguauucauuaugcacagcagcauuuacauuuacaaaaauuccggcggaaacacuacauggaacaguaacaguagaaguacaauaugcgggaacagacgguccauguaaaguaccugcacaaauggcaguagauacacaaacuuugacaccaguaggaagacuaauuacagcaaauccaguaauaacugaaucaacagaaaauucaaaaaugauguuagaauuagauccaccuuucggagauaguuacauaguaauuggagugggggaaaagaaaauaacccaccacuggcaccgaagcgguucaacuauaggaaaagcauuugaggcaacaguuagaggcgcaaaaagaauggcgguauuaggagacacagcaugggauuucggaucuguaggaggggccuuaaacucacuaggaaaaggaauacaucaaauauuuggagcagcguuuaaaucacuauuuggugggaugucuugguuuagccaaauacuuauaggcacgcuacuaauguggcucgguuuaaauaccaaaaauggaucuauaaguuuaaugugucuagcauuaggaggaguacuaauauuuuugaguacagcagugucagcugauguaggcuguucaguagauuuuucaaaa

SEQ ID NO: 2589 - RNA, 2136 nt, Artificial Sequence
  KU761561.1 prME-long CDS opt
agaauuauaaaugcaagaaaagaaaaaaaaagacgaggagcagacacuaauguagguaucguaggacuauuauuaacgacagccauggcagcugaaguaacccgaaggggaucggccuauuacauguauuuagauagaaaugaugcaggagaagcaauaaguuuuccaacaacguuagguaugaauaaauguuacauacaaauaauggauuuaggucauaugugugacgcaacaaugaguuacgaaugcccaauguuagaugaagguguggaacccgaugacguugauugcuggugcaauacaaccucaacauggguugucuaugggacaugucaucauaaaaaaggagaagcaagaagaaguagaagggccguuacucuuccaagccauagcacaagaaaacuccaaacuagaucacaaacauggcuagaaaguagagaauacaccaaacacuuaauaagaguagaaaauuggauauuuagaaauccaggauuugcauuagcagcagcagcuauagcauggcuauuaggaucgucuacaagucaaaaaguaauauauuuaguuaugauacuacuaauagcaccagcauacagcauaaggugcauaggcguaucaaacagagauuuuguugaaggaaugucaggaggaaccuggguagauguaguguuagaacauggagggugcgugacaguaauggcccaagauaaaccaacaguugauauagaacuugucacgacaacagugucaaacauggccgaaguaagauccuauuguuacgaagcaucaauaucggauauggcauccgauagcagauguccuacacaaggagaagcauauuuagacaaacaaagcgauacacaauauguauguaaacgaacauuaguugacagagggugggguaauggguguggacuauucgguaaagguaguuuagucacuugcgcaaaauuugcauguucuaagaaaaugacaggaaaaucaauacaaccggaaaaccuagaauacagaauaaugcuaucagugcauggaucacaacauagcggaaugauaguaaaugacacuggucacgagacagaugaaaauagagcaaaaguagaaauaacaccaaauucaccaagagcggaagcaacauuaggagguuuuggaucauugggauuagauugcgaaccaagaacaggauuagauuuuucagaucuuuauuaucugacaaugaauaauaaacauuggcuagugcacaaagaaugguuccaugauauaccccuaccauggcaugcaggugccgauaccggaacaccacauuggaauaauaaagaagcauuaguugaauuuaaagaugcucacgccaaaagacaaacaguaguaguauuaggcucacaagaaggggcaguacauaccgcauuggcuggagcguuagaagccgaaauggacggugccaaaggaagacucucaaguggucauuugaaaugcagacuaaaaauggauaaauuaagauuaaaaggaguaucauauaguuuaugcacagcugcauuuacauuuacaaaaauaccagcagaaacucuacauggaacaguuacaguugagguucaauaugcaggaacagauggaccaugcaaagucccugcacaaauggcaguagacaugcaaacacugacaccuguaggaagauuaauaacugcaaauccgguaauaacagaaaguaccgaaaacucgaaaaugauguuagaacuugauccuccguucggagacagcuacauuguaauaggaguaggagaaaaaaaaauaacgcaucacuggcauagaucaggaucgaccaucggaaaagcauuugaggccacugugaggggagcaagaagaauggcaguauuaggcgauacagcuugggauuuugguucagucggaggagcauugaauaguuugggaaaaggaauacaucaaauauuuggagcagcauuuaaaucauuauuuggugguaugagcugguucucccagauauuaauaggaacacuauuaaugugguuagguuuaaauacuaaaaauggaaguauaucauuaauguguuuagcuuuaggaggcguacuaauauuuuuaucaacggcuguuucagcagaugugggaugcucaguagacuucucaaaa

SEQ ID NO: 2590 - RNA, 2136 nt, Artificial Sequence
  KY317938.1 prME-long CDS opt
aggauaauuaaugcuagaaaagaaaagaaaagaagaggagcagaaacaaguguaggaaucguugguuuauuauuaacaacugcuauggcagccgaaguaacaaggagagggagugccuauuacauguauuuagacagaaaugacgcaggagaagcaauuuccuucccaacuacuuuagguaugaacaaauguuauauacaaauaauggauuugggacauaugugcgaugcgacaaugaguuaugaauguccaaugcuagacgaaggagucgaaccugaugacguagacuguugguguaacaccacaaguacauggguaguauauggaacgugccaucauaagaaaggagaagcgagaagaaguaggagagccguaacauuaccaagucacagcacaagaaaauuacaaacaagaagucaaacaugguuagaaucaagagaauauacaaaacaccuaauaaggguagaaaacuggauauuuagaaauccaggauuugcauuggcagcagcagccauagcaugguuguuaggaucaaguacaagucaaaaaguaauauauuuaguaaugauauuauuaauagcaccagcauauucaauaagaugcauagguguaucaaauagagacuuuguagaagguaugaguggaggaacuuggguagauguaguuuuagaacacggaggaugcguaacaguaauggcucaagacaaaccaacaguagauauagaauuagucacuacaacaguaucaaauauggcagaagucagaagcuauuguuacgaagcaagcauuucagacauggcaucugauucacguuguccuacgcaaggagaagccuauuuagauaaacaauccgacacacaauauguauguaaaagaacccuaguagacagagguugggguaauggauguggccuauucgggaaaggaaguuuagucacaugugcuaaauuugcaugcaguaagaaaaugacaggaaaaucaauacaaccggaaaaucuagaauacagaauaaugcuaaguguacauggaagucaacauuccggcaugauagugaaugauacugggcaugaaaccgaugaaaacagagcaaaaguagaaauaacaccaaauucuccgcgugcugaagcuacacuagggggauuuggaucauuaggucuugacugugaaccaaggacugguuuagauuucucggaucuauauuaucuaacuaugaauaacaaacauuggcuuguacauaaagaaugguuucacgauauaccacuaccauggcaugcaggagcagauacagggacuccucacuggaacaauaaagaagcauuaguugaguuuaaagaugcacaugcaaaaagacaaacuguaguuguauuaggcucacaagaaggugcaguacacacagcucuagcaggggcucuagaggcggaaauggauggugcaaaaggaagacuuucaaguggacacuuaaaaugcagacuaaaaauggauaaauugagauuaaaaggaguaaguuauucuuuauguacagcagcauucacauuuacaaaaauaccagcagaaacauuacauggaacaguaacaguugaaguacaauacgcgggaacagaugggccaugcaaagucccagcgcaaauggcuguagacaugcaaacgcugacacccguagggcgacuaauuacugcaaauccaguaauaacugaaaguacagaaaacaguaaaaugaugcuggaauuagaucccccguuuggagacagcuauauaguaauaggaguaggugaaaagaaaaucacacaucauuggcauagaucagguucaacaauaggaaaagccuuugaagcaacaguuagaggagccaaacggauggcagugcuuggagauacggcuugggacuucggaucaguaggaggcgcauuaaacaguuuagggaaaggaauacaccaaauuuucggugcagcuuuuaaaaguuuauuuggaggaaugucaugguuuucucaaauauuaauaggaacuuugcuaauguggcuaggauuaaacaccaaaaauggaucaauaucacugaugugucuagcucuaggugguguauuaauauuucuaucaacagcaguuucagcagauguuggaugcucaguugauuuuucgaaa

SEQ ID NO: 2591 - RNA, 2136 nt, Artificial Sequence
  KY075939.1 prME-long CDS opt
agaauaauaaaugccagaaaagaaaagaaaagaagaggugcagauacauccguaggaauaguaggauuacuuuuaacaacagcaauggcagcagaaguaacaagaagggguucagcauauuauauguaccuagauaggaaugacgcgggagaagcuauaucauuucccacaacccuaggaaugaauaaaugcuauauacagaucauggaccuuggacauaugugugaugcaacaaugucauacgaauguccaauguuagaugaaggaguagaaccggaugacgucgauugcuggugcaacacuacgaguaccuggguagucuauggaacaugucaucauaaaaagggagaagcaagacgaaguaggagagcagucacuuugccaagucacaguacuagaaaacugcagacaagaagucaaacaugguuagaaucaagagaauauacuaagcaccuaauaagaguugagaauuggauauuuagaaacccagguuuugcucuugcagcugcggcuauagcguggcuguuaggaucaucaacaagucaaaaaguuauauacuuagugaugauauuauuaauugcuccugcauauucacuaagauguauuggaguaaguaauagagauuuuguagaagguaugaguggaggcacguggguugauguaguacuagaacauggcggauguguuacaguaauggcacaagauaaaccuacaguagauauagaauuaguaacuacuacaguaaguaauauggcagaaguuagaaguuacuguuaugaagcaaguauaucagauauggcaagugauucaagaugucccacgcaaggagaggcuuaucuagauaaacaaucagauacacaauacgucuguaaacgaaccuuaguagaucgagguuggggaaaugggugcgguuuauucggaaaaggaucauuaguaacuugugcaaaauuugcauguucaaagaaaaugacaggaaaaagcauccaaccagaaaacuuagaauauagaauaauguuaaguguacaugguucucaacauucaggaaugauaguaaacgacacaggccaugaaacagaugaaaauagagcaaaaguagaaauaacaccaaauucaccaagagcugaagcgacuuuaggaggauuugguagcuuagguuuagauugugaacccagaacaggauuggauuucagugauuuauauuaucuaacgaugaauaacaaacauugguuaguacauaaagaaugguuccaugauauaccauugccuuggcaugcuggagcagauacaggaacgccacacuggaauaauaaagaagcauuaguagaauuuaaagaugcacacgcgaaaagacagacaguagucguacuaggaucacaagaaggagcaguacauacagcauuggccggagcuuuagaagccgaaauggauggagcaaaaggcagauuaagcaguggccacuuaaaaugucgauuaaaaauggauaaauuaagauuaaaaggagucaguuacagcuuauguacagcugcauucacauuuaccaaaaucccagcagaaacauuacaugguacugugacaguagaaguacaauacgcuggaacagauggcccuuguaaaguaccagcacaaauggcaguagauaugcaaacauuaacaccgguaggaagguuaauuacugcaaauccaguaauaacugaaucaacagaaaauaguaaaaugaugcuagaauuagacccacccuuuggggauaguuauauagugauaggaguaggagaaaagaaaauaacacaccacuggcaucguagcggaaguacaauaggaaaagcauuugaagcuacgguaagaggggcaaaacgaauggcugugcuaggggacacagccugggauuucggaucagugggaggugcauuaaauucauuaggaaaagggauacaucaaauauucggagcugcguuuaaaucauuauucggaggaaugaguugguuuucucaaauauuaauuggaacgcuucuaauguggcuaggacuaaauacuaaaaacgguucaauaucucugauguguuuagcauugggaggaguacuaauauuccuuaguacagcaguaagugcggauguaggcugcucaguagauuuuaguaaa

SEQ ID NO: 2592 - RNA, 2136 nt, Artificial Sequence
  KX806557.2 prME-long CDS opt
agaauuauaaacgcaagaaaagaaaaaaagagaagaggagcugacacuaauguaggaauaguaggacuguuauuaacaacagcgauggcagcagaaguaacgagaagaggaucugcauacuauauguauuuagauaggaaugaugcaggagaagccauaucauuuccgacaacauugggaaugaauaaauguuacauacaaauaauggaucuaggacauaugugugacgcaacaaugaguuacgagugucccauguuagaugaagggguugagccagacgauguggauuguugguguaacacaacaaguacuuggguuguauauggaacuugccaccauaaaaaaggugaagcuagaagaucacguagggcgguaacacuaccaucucacaguacccguaaacuacaaacgagaagccagacaugguuagaaagcagagaauauacaaaacauuuaauaagagucgaaaauuggauguuuagaaauccaggcuuugcauuagcagcagccgcuauagcauggcuucuuggaucaaguacaucacaaaaaguuauauauuuaguaaugauauuguuaauagccccagcuuacucaauaagauguauuggaguaagcaacagagauuuuguagaaggaaugaguggaggaacauggguugauguaguacuagagcauggugggugcguaacagucauggcgcaagacaaaccuacaguagauauagaauuaguaacaacaacaguaaguaauauggcagaagugcgaucauauuguuacgaagcaagcauuucugauauggcaucagauagucguuguccaacacaaggagaagcauaccuagauaaacaaucagauacccaauacguauguaaaagaacuuuaguagaucgagguugggguaauggauguggacuauuugguaaaggaagccuaguuacuugugcuaaguuugcaugcaguaaaaaaaugacagguaaaucaauacaaccagaaaaucuagaguauagaauaauguuaaguguacauggaagucaacauagugguaugauuguaaaugauacaggacacgaaacagacgaaaaccgagcuaaaguagaaaucacgccaaauagucccagggcagaagcaacauuaggaggauuuggcucguuaggauuagacugugaaccacgaacugggcuagauuuuagcgauuuauauuaucuaacaaugaacaacaaacacugguuaguacauaaagaaugguuucaugauaucccacuaccuuggcaugccggagcagacacaggaacaccacacuggaauaauaaagaagcacuaguagaguuuaaagacgcacaugcgaaaaggcaaacaguaguaguacuaggaucacaagaaggagcgguacauacggcacuagcuggagcccuagaagcagagauggacggcgcuaaaggaagauugagcaguggacaccuaaaaugucguuugaaaauggauaaauuaagacucaaaggaguaaguuauucguuaugcacagcugcguuuacauuuaccaaaauaccagcagaaacgcuacauggaaccguaacgguggaaguucaauaugcaggaacagauggaccaugcaaaguaccagcucagauggcgguagacaugcaaacauuaacaccaguagggagguuaauaacagcaaacccugugauaacugaaaguacagaaaauaguaagaugaugcuagaacuagauccaccauucggagauucauauauaguaauaggaguaggggaaaaaaaaauaacucaucauuggcauagaagugguaguacaaucggaaaagcauuugaagcaacaguacgcggggcaaaaagaauggcaguacuuggagauacagcaugggauuuuggaaguguaggaggugcguuaaauaguuuaggaaaaggaauacaucaaauauucggggcagcauucaaaaguuuauuuggaggaaugaguugguucagucaaauauuaauaggaacauuguuaauguggcuaggucuuaauacaaaaaaugguucaauaaguuuaaugugucuugcauuaggaggagucuuaauauuuuuaagcacagcaguaagugcggacguuggguguucaguugacuuuaguaaa

SEQ ID NO: 2593 - RNA, 2136 nt, Artificial Sequence
  KU870645.1 prME-long CDS opt
agaauaauaaaugcacgcaaagagaaaaaaagaagaggagcagauacaaguguaggaauaguugguuuauuacuaacaacagcaauggcagcugaagucacaagaagaggaucagcauauuauauguaccuagacagaaacgaugcuggagaagcgauaucauuuccuacgacacuugguaugaauaaaugcuauauucaaauaauggacuugggacauaugugugaugcaaccaugucauacgaaugcccuauguuagaugaggguguagaaccugacgauguagauugcugguguaacacaacuaguacuuggguaguuuauggaacaugucaccacaaaaagggagaagcaagaagaucaagaagggccguaacucucccaucacacaguacaagaaaauuacaaacaagaucacaaacgugguuagaaucaagagaauauacaaaacacuuaauaagaguugaaaauuggauacuacguaauccaggauucgcacucgcagcugcggcuauagcauggcucuuagguucgaguaccucucagaagguaauauacuuaguaaugauauuauuaauagcaccagcuuauucuauaagauguauaggagucaguaauagagauuuuguugaaggaaugucaggaggaacuuggguagacgugguacuggaacacggaggaugcgugaccguuauggcgcaagauaaaccaacgguagauauagaauuaguaacaaccacaguuaguaauauggccgagguaaggucuuauuguuaugaagccucuauaucugacauggcaucagacucaagaugcccuacacaaggagaagcauauuuagauaaacaaucagauacacaauauguauguaaacgaacacuaguagauaggggcugggguaauggaugcggacuauucggaaaaggaaguuuagucacaugugcaaaauucgcauguucuaaaaaaaugacaggaaaaucaauacaaccagaaaauuuagaauaucgaauuauguuaucaguacauggaucacaacauucuggaaugauaguaaacgacacaggccacgaaacagacgaaaauagagcaaaaguugaaauaacaccaaauaguccucgagccgaagcaacacuuggagguuuuggaagucuaggauuagauugugaaccaagaacaggauuagacuucucggaucuauauuaucugaccaugaauaauaaacauugguuagugcacaaagaaugguuucaugauauaccguuaccauggcaugccggagcagauacaggcacaccacauuggaauaauaaagaagcacuaguagaauucaaagaugcucacgcuaaaagacaaacagugguaguauuagguagccaagaaggagcaguacacacagcccuagcaggugcucuugaagcagaaauggauggagcaaagggaagauuaaguuccggacaccugaaaugcagacuaaaaauggauaaauuaagacuaaaaggagucucauauucauugugcacagcagcauuuacuuuuacaaaaauuccagcagaaacguugcacggaacaguaacuguagaaguacaauacgcaggaacagauggaccguguaaaguaccagcacaaauggcaguugauaugcaaaccuuaacaccaguuggaagauuaauaacugcaaacccaguaauaacagaaaguacggaaaauucaaaaaugauguuagaauuagauccuccauucggagauucauacaucguaauaggaauaggagaaaaaaaaauaacacaucauuggcacagaucgggaucaacaauagguaaagcauuugaagcuacaguaagaggagcaaaacggauggcaguauuaggagacacugccugggauuuuggaucaguagggggagcauuaaauucacuaggaaaaggcauccaucaaauauuuggugcugcuuuuaaaucccuauucggaggaaugagcugguucucacaaauacuuauuggaacucugcuaauguggcuaggauuaaauacaaaaaauggaagcauaagcuuaaugugucuagcucuaggaggcguucuaauuuuuuuaaguacagccguaucagcugacguaggauguucagucgauuucucaaaa

SEQ ID NO: 2594 - RNA, 2136 nt, Artificial Sequence
  KU729217.2 prME-long CDS opt
agaauaauuaacgcuagaaaagaaaagaaaagaagaggagcugacacaagcgugggaauaguaggacucuugcuaacaacagcaauggcugcagaaguaacaagaagaggaagugcauauuauauguauuuggaucgaaaugacgcaggagaagcaauaucauuuccaacaacacucggaaugaauaaaugcuauauacaaauaauggaucucggacauaugugcgacgccacaaugucuuaugaauguccuaugcuagaugaaggaguagaaccagacgaugucgauuguugguguaauacaacaagcacaugggugguauacggaacaugucaucauaagaaaggugaagcaaggagaaguagacgggcaguaacacuaccaucacauaguacgcgaaaacuacaaacaagaucacaaacuuggcuagaaucaagagaauacacaaaacaucuaauuagaguagaaaacuggauauuuagaaacccaggcuucgcacuggcagcagcagcaauagcaugguugcuagggucaagcacaucacaaaaaguuauauauuuaguaaugauauuauugauagcuccagcauacaguauaagauguauaggagugucaaaucgagauuuuguugaaggaaugucaggaggcacuuggguagauguaguauuagaacauggugguugcguaacaguaauggcucaagauaaaccaacaguagauaucgaauuaguaucaacaacaguuucaaacauggcagaaguaagaucuuauuguuacgaagcaaccauaagcgauauagcaagugauucaagguguccuacacaaggagaagcauaucuagacaaacaaucagauacacaauacguaugcaaaagaacauuaguugauagaggauggggaaauggaugcggguuauuuggaaaagggaguuuaguaacuugugcaaaauuugcguguucaaagaaaaugacaggaaaaucaauacaaccagaaaacuuagaauaucgaauuauguugucaguacauggaucacaacauagcgggaugauagucaaugauacaggacaugaaacugacgaaaauagagcaaaaguagaaauaacaccaaauagcccuagagccgaagcuacauuaggaggauuugguucacucggacuagacugugaaccaaggacuggucuugauuuuucagauuuauauuacuuaacaaugaauaauaaacacugguuaguccacaaagaaugguuucaugacauaccauugccuuggcaugcaggagcagauaccggaacaccacacuggaauaauaaagaagcauugguagaauuuaaagacgcucaugcaaaaaggcaaacagcuguuguacucggaucucaagaaggagcaguucacacagcuuuagcuggagcacuugaagcagaaauggauggagcaaaaggaagacuaucuucgggccauuuaaaaugcagacuaaaaauggauaaauugcgauuaaaagggguuaguuacaguuuauguacagcggcuuuuacuuuuacaaaaauaccagcagaaacacuacauggaacaguaacaguagaaguacaauaugcggguacagauggcccaugcaaaguaccagcacaaauggcaguagauaugcaaacacuaacgccaguaggaaggcugauuacagcaaauccaguaauaacagaaucuacugaaaacucaaaaaugaugcucgaacuagauccaccauuuggggauucuuauaucguuauaggcguaggcgaaaagaaaauuacacaccauuggcacagaucaggaucaacaauaggaaaagccuuugaagcuacaguaagaggugcaaaaagaauggcuguucuuggagacacagcaugggauuuugguaguguagggggagcauugaacucacuagggaaaggcauacaucaaauuuuuggugcagcauuuaaaucauuauucggaggaaugagcugguuuagccaaauucuaauuggaacuuuacugauguggcuaggccuuaauacuaaaaauggaaguauaucacuuaugugcuuagcauuaggaggaguacugauauuuuuaucaacagccguuucagcagacguugguugcaguguugauuuuaguaaa

SEQ ID NO: 2595 - RNA, 2136 nt, Artificial Sequence
  KU497555.1 prME-long CDS opt
agaauaauaaacgcucguaaagaaaaaaagagaagaggagcagacacaaguguaggcauaguaggauugcuuuugacuacagcaauggcagcagagguaacaaggagagggucagcuuauuauauguacuuagacagaaacgacgcaggugaagccauauccuuuccgacaacacuagguaugaauaaaugcuacauacaaaucauggauuuaggacauaugugcgaugcaacaaugagcuacgaauguccaauguuagaugaaggaguagaaccagaugauguugauuguugguguaacacaacuagcacauggguagucuauggcacaugucaccacaaaaaaggcgaagcuagaagauccagacgagccguaacauuaccuagucauagcacgagaaagcuacaaacaagaagccaaacaugguuagaaaguagagaauauacaaaacaucuaaucagaguggaaaacuggauauucagaaaccccgguuuugcauuagcugcagcagccauagcauggcuauuaggaaguucaacgagccaaaaaguaauauauuuaguaaugauauuacugaucgcuccagcauauucaauacgauguauagggguaagcaauagagacuucgucgaaggaaugucaggaggaacauggguagauguugugcucgaacacggugguugugucacaguaauggcacaagauaaaccaaccgucgauauagaacuaguaacaacaacaguuucaaauauggcagaaguaagaucuuacuguuaugaggcaaguauaagugauauggcgucagauucaagaugcccaacucaaggagaagcauauuuagauaaacaaagugauacacaauacguauguaaaagaacuuuaguagauagaggauggggaaauggcuguggucuauuuggcaaaggaagucuaguaacuugugcaaaauucgcaugcagcaaaaaaaugacaggaaaaagcauacaacccgaaaacuuagaauaucgaauaaugcugucaguccauggaagucaacacagugguaugauaguuaaugauacuggacaugaaacagacgaaaauagagcgaaaguagagauaacuccaaauucgcccagagcagaagcuacccuaggagguuuuggaucacucgguuuggauugcgaaccucgaacagguuuagacuuuagcgacuuauauuaccuaacaaugaacaauaaacauuggcuaguacacaaagaaugguuucaugauauaccuuuaccauggcaugcuggcgcagauacaggaacaccgcauuggaauaauaaagaagcacuaguagaauuuaaagaugcacaugccaaaagacaaacugucguuguauuagguacacaagaaggagcuguacauacagcauuagccggagcauuagaagcagagauggacggugcaaaaggccgauuaaguucagggcaucuaaaauguagauugaaaauggacaaauuacgacuaaaaggaguuucauauucauuauguaccgcagcauucacuuuuacaaaaauaccugcagagacauuacaugguacaguaacaguagaaguacaauaugcaggaacagacggaccauguaaaguaccugcucaaauggcaguagauaugcagacucuaacaccagucggcagauuaauaacagcaaaucccguaauaacagaaucgacggaaaauucuaaaaugauguuagaacucgauccuccauuuggagauaguuacauaguaauugggguaggagaaaaaaaaaucacucaucauuggcauagaaguggaucgacgauaggaaaagcauucgaagcaacaguacgaggagcuaaaagaauggcuguuuuaggugacacugcaugggacuuuggaucaguuggaggagcguuaaauagcuuaggaaagggaauacaucagauauuuggagcagcguucaaaagucucuucgguggaaugucaugguucagucaaauacugauagguaccuuauuaauguggcuaggauuaaauacaaaaaacgguuccauuagucuuauguguuuagcauuaggcggaguauuaauauucuuaucaacagcaguaucggcagacguaggauguaguguagauuucucaaaa

SEQ ID NO: 2596 - RNA, 2136 nt, Artificial Sequence
  KX087101.3 prME-long CDS opt
agaauaauaaaugcccguaaagaaaagaaaagaagaggugcagauacaucaguggguaucguagguuuauuauuaacaacagcgauggcagcggaaguaacaagaagaggcucagcauauuauauguaccuagacagaaacgaugcgggagaagcaauaucuuuuccuacaacacuuggaaugaauaaaugcuauauacaaauuauggacuuaggacacaugugugaugcuacaaugagcuacgaauguccaauguuagaugaaggaguagaaccagaugacgucgauugcuggugcaacacuacgagcacauggguuguuuacgguacaugccaccauaagaaaggagaagcacgaagaucaagaagggcugucacguuaccgucacauucaacaagaaaauugcaaacaagaucacaaacaugguuagagucaagagaauauacaaaacauuuaauuagaguagaaaauuggauuuuuagaaauccagguuuugcacuugcagcagcugcuauagcaugguuauuaggaucaagcacaucacaaaaagucauauauuuagugaugauuuuacuaauugcacccgcauacagcauaagauguauaggaguaucaaauagagacuucguagaaggaaugucgggaggaacuuggguagauguaguauuagaacaugggggauguguaacaguaauggcucaggauaaaccaacuguugauauugaauugguaacaacaacagugaguaauauggcugaaguaagaaguuauuguuacgaagcaaguauaagugauauggcaagugauucaagguguccuacucaaggagaggcauacuuagacaaacaaucugacacucaauauguauguaaacgaacauuagucgaucgagguugggguaauggauguggucuauuuggaaaaggaucgcuaguaacaugugccaaauuugcauguaguaagaaaaugacaggaaaaaguauucaaccagagaacuuagaauaucgaauuauguuaucaguucauggaagucaacauaguggaaugauaguaaaugacaccggucaugaaacggaugaaaauagagcaaaaguugagauaacaccaaauaguccuagagcagaagcaacacuaggagguuucggaagucuagguuuagauugugaaccacgaacaggauuagacuuuagcgaucuauacuacuuaacuaugaacaauaaacacugguugguacacaaagaaugguuucaugacauaccacuaccguggcacgcuggagcugauacuggaacaccacauuggaauaauaaagaagcauugguagaguuuaaagaugcacacgcaaaaagacaaacaguaguaguauuaggaagccaagaaggagcaguacauaccgcauuggcuggugcauuagaggcagaaauggauggugcuaaagguagguuaaguucaggccauuuaaaauguagauuaaaaauggauaaauuaagacuaaaaggugucucauacagcuugugcacagcagcauucacauuuacaaaaaucccugcagaaacauugcauggaacgguaaccguagaauuacaauaugcaggcacagauggaccuuguaaaguaccagcucaaauggcaguagauaugcaaacuuuaacuccaguaggaagauuaauaacugcaaauccagugauaacggaaaguacugaaaacaguaaaaugauguuagaacuugauccgccauuuggagacagcuacauagugauaggugugggagaaaagaaaauaacccaucauuggcaccgaucaggaucaacaauaggaaaggcuuucgaagcaacaguuagaggcgcaaaacgcauggcuguauugggagauacugcaugggauuuuggaaguguagguggggcauuaaacaguuuaggaaaaggaauacaucaaauuuucggcgcagcauuuaaaucauuauucggaggaaugagcugguuuucacaaauacuuauaggaacacuacuaaugugguuagguuuaaauacuaaaaacggaaguauuucauuaauguguuuagcacucggagguguauuaauauuccuaucaacagcaguaucagcagacguaggaugcagcguagacuuuaguaaa

SEQ ID NO: 2597 - RNA, 2136 nt, Artificial Sequence
  KY075932.1 prME-long CDS opt
agaauaauaaaugcaagaaaagaaaagaaaagaagaggagcagaaacaaguguaggaaucguuggauuauuauuaacaacagcaauggcagcagaaguaacgagacggggaucagcuuauuacauguauuuggauagaaaugaugcaggagaagcuauuagcuuuccaacaacacuggguaugaauaaauguuauauacaaauaauggacuugggucauaugugcgacgcaacaaugucauaugaaugucccauguuagaugaaggaguagaaccagacgauguagauuguugguguaauacaacaaguacauggguaguauaugguacgugccaucauaaaaagggagaagcaaggagaucaagaagggcaguaacauuaccuagccauagcacucgaaaauuacaaacaagaagucagacgugguuggaaucaagagaguauacaaaacacuuaauacggauagaaaauuggauauucagaaacccagguuucgcucuggcugccgcagcaauugccuggcuauuagggucaagcaccucacagaaagugauuuacuuaguaaugauacuauuaauagcuccugcauacagcauuagauguauaggcguuucaaaccgagacuuugucgaaggaaugucgggagguacaugggucgauguaguauuagagcacggaggaugugugacaguaauggcacaagacaaaccaacagucgacauagagcuaguaacaacaacuguaaguaauauggcagaaguuagaucauauuguuaugaagccaguauaagugauauggcuagugauuccagauguccaacacaaggagaagcauaucuugauaaacaaagcgauacacaauauguuuguaaaagaacuuuaguagauaggggaugggguaacggguguggacuauuuggaaaaggaucuuuaguuacaugugcaaaauuugcauguaguaagaaaaugacaggaaaaucaauacaaccagaaaauuuagaauauagaauuauguugucaguacaugguucacaacauagugguaugauaguaaaugacaccgggcaugaaacagacgaaaauagagcaaaaguagaaauaaccccaaauagcccgagagcagaggcaacauuggguggauuuggaagccuuggacuagauugugaaccaagaacagggcuagauuucagugaccuguacuauuuaacaaugaacaacaaacauugguuaguccauaaagagugguuccaugauauccccuuaccauggcacgcaggagcagacacgggaacaccacacuggaacaauaaagaagcauuagucgaauuuaaagaugcacaugcaaaaagacaaaccguagugguauuaggaucacaagaaggugcaguucauacagcuuuagcuggagcacuugaagcagaaauggauggcgcaaaaggaagauuaucaaguggacauuuaaaauguagauuaaaaauggauaaauugagacuaaaagguguaucauacaguuuauguacagcagcauuuacuuuuacaaaaauaccugcagaaacauuacacgguacaguaacaguagaaguacaauaugcaggaacagacggaccaugcaaagucccggcacaaauggcuguagauaugcaaacacuaacaccagugggaagauuaauuacagcaaauccaguaauaacagaaucaacugaaaauucgaaaaugaugcuagaauuggauccaccauuuggagacaguuauauaguaauugguguuggcgaaaagaaaauaacacaucauuggcauagaucaggaucaacuauaggaaaagcauuugaggcuacagugcgaggagcuaaacgaauggcaguguuaggugauacggcaugggauuuuggaaguguaggcggugcccuaaauucacuuggaaaaggcauacaccaaaucuuuggagcagcauucaaaucgcuauuugguggaaugaguugguuuagucaaauauuaaucgggacuuuauuaaugugguuaggauuaaauacuaaaaauggaagcauaucacuaauguguuuagcguuaggaggaguauuaauuuucuuaagcacagccguaucagcagaugugggaugcaguguagauuucucgaaa

SEQ ID NO: 2598 - RNA, 2136 nt, Artificial Sequence
  KY014317.1 prME-long CDS opt
agaaucauaaaugcuagaaaagaaaaaaaaagacggggagcagauacaucaguaggaauagugggauuauuacuaacaacugcaauggccgcagaaguuacacgaagagggagugcauauuauauguaucuagaccgaaaugaugcaggagaagcaauaagcuuuccaacaacccuuggaaugaauaaauguuauauacaaauaauggauuuaggacauaugugugacgcaacaaugucauaugaaugcccgauguuagacgaagggguagaaccagacgauguagacugcugguguaauacaacaucaacauggguuguauacggaaccugccaucauaaaaaaggagaagcaagaagaaguagaagggcgguaaccuuaccuucucauucaacuagaaaacuucaaacuagaucacaaacuugguuagaaaguagggaauauacaaaacauuuaauaagaguagagaauuggauuuuuagaaauccaggauuugcauuagcagcagcagcaauagcaugguuacucgguucaucaacaagucaaaaaguaauuuacuuaguaaugauuuuacuaauugcacccgccuacucaauuagauguauaggaguaucaaauagagauuucguagaaggaaugaguggaggcacuuggguugauguaguauuagaacaugguggcuguguaacagucauggcacaagauaagccaacaguagauauagaacuaguaacaaccaccguaucaaacauggccgaaguacgaucguacuguuaugaagcaucaauuagugacauggcaucagauaguagaugucccacacaaggagaagcauaucuagauaaacaaagugauacucaauauguauguaaaagaacauuaguagaucgagguugggguaauggauguggacuauuuggaaaaggaucucuagucaccugugcaaaauuugcuuguucaaaaaaaaugacaggaaaaagcauucaaccagaaaauuuagaauauagaauuauguuaucaguacauggaagccaacauucuggaaugauaguaaaugauacuggacacgaaacagaugagaauagggcaaaaguugaaauaacaccaaauucaccuagagcagaagcaacauuaggcgguuuugguagcuuggguuuggauugugaaccuagaacaggacuagauuuuagugauuuauauuaucuaacaaugaauaauaaacauuggcugguacauaaagaaugguuucaugauauaccauuaccuuggcaugcaggagccgauaccgguacgccucauuggaacaauaaagaagcacuuguagaauucaaagaugcacacgcaaaacgucaaacaguaguaguauuaggaucacaagaaggggcaguacauacggcguuagcaggcgcauuagaagcagaaauggauggagcuaaaggucgucuuucaaguggacauuuaaaauguagguuaaaaauggauaaacuacgauuaaaaggcguaucuuauucauuauguacagcagcauuuacuuuuaccaaaauaccagcagagacccuacauggaacagucacgguagaaguacaauaugcugguacugauggaccauguaaaguaccugcucaaauggccguagauaugcaaacauuaacaccagugggaagacuaauaacagcaaauccgguuauuacagaaagcauagaaaauucaaaaaugauguuagaacuagauccacccuucggugauucauauauaguuauaggcguaggggagaaaaaaauaacgcaucacuggcaucgaucaggaaguacaauaggcaaagcauuugaagcuacuguacguggagcaaaacgaauggccguucucggggacacugcuugggacuucggcucaguaggaggggcgcuaaauagucucggaaaaggcauacaccaaauuuuuggagcagcuuucaaaucauuauucggaggaaugucgugguucagucaaauauuaaucggaacacuacuaauguggcuaggacucaauaccaaaaaugggaguauaaguuuaaugugucuagcauuaggagguguuuuaauauuuuuaucaacugcuguuucagcagacguaggaugcucaguugauuuuucaaaa

SEQ ID NO: 2599 - RNA, 2136 nt, Artificial Sequence
  KU758876.1 prME-long CDS opt
agaauaauaaacgcaaggaaagaaaagaaaagaagaggagcugauacaucuguaggaauuguaggguuacuauuaacaacagcaauggcugcggagguaacaaggaggggcucagcauacuauauguaucuagaccgaaaugaugcaggagaagcaauaaguuucccaacaacauugggaaugaauaaauguuacauacaaauaauggauuuaggccauaugugcgaugcaacaaugaguuaugaaugcccgaugcuagaugaaggaguugaacccgaugaugucgauuguugguguaauacaacaaguacuuggguaguauacggaacaugucaucauaagaaaggugaagcuagaagaucaaggagagcgguaacacuaccgucacauucaaccagaaaauuacaaacaagaucacaaaccugguuagaaaguagagaauauacaaaacauuuaauaagaguagaaaacuggauauuuagaaauccagguuuugcauuggcugcugcagcuauagcaugguuacuaggaagcucaacaagucagaaaguaauauaucuagucaugauuuuacuaaucgcaccagccuacaguauaagguguauaggaguaucaaauagagacuuuguagaagguaugaguggagguacauggguagacguaguacuagaacacggagguuguguaaccguaauggcccaagauaaaccgacaguagacauagagcuaguaacaacaacaguuucaaauauggcugaaguuagaagcuauugcuaugaagccucaauaagcgacauggcuagugauucaagaugucccacacagggagaagcauauuuagauaaacagucagacacucaauauguauguaagagaacauuaguagacagggguuggggaaauggauguggauuauucggaaaaggaagucuuguaacaugcgcaaaauuugcauguucgaagaaaaugacaggaaaaaguauacaaccagaaaacuuagaauauagaauaaugcuuaguguacauggaagucaacauaguggaaugauaguuaaugauacuggucaugaaacagaugaaaauagagcaaaaguagaaauaacuccaaacagcccuagagcagaagcuacauuaggaggauuugguaguuuaggacuagauugcgagccuagaaccgggcuggacuuuucugauuuauauuacuuaacaaugaacaauaaacauuggcuaguacauaaagaaugguuccaugauauaccuuugccauggcacgcaggggcagauacaggaacaccucauuggaauaacaaagaagcucuaguagaauuuaaagaugcacaugcaaaaagacaaacaguuguuguauuaggaagucaagaaggagcaguacacacagcacuagcaggagcauuagaagcagaaauggauggaguaaaaggccggcuuagcagcggucaucuaaaauguagauuaaaaauggacaaacuaagguuaaaagguguaaguuauagucuguguacugcggcauuuacauuuacaaaaauaccagcagaaacauuacaugguaccguaacaguagaaguacaauacgcaggaacggauggacccuguaaaguuccugcacaaauggcaguagacaugcaaacacuaacaccuguggguaggcuaauaacugcaaauccgguaauaacagaaucaacugaaaauaguaaaaugaugcuugaauuggaucccccuuuuggagacaguuauauaguaauagggguaggagaaaagaaaauaacucaccacuggcauagaagcggaucaacuauagggaaagcguucgaagcaacaguacgaggcgcaaaaagaauggcaguauuaggagacaccgcaugggauuuugguaguguaggaggugcacuuaauagccuaggcaaaggcauacaccaaauauucggagcugcauuuaaaucauuauuuggagggaugagcugguucucacaaauauuaaucggaacauuauuaauguggcuuggacuaaauaccaaaaauggaucaauaucauuuaugugucuagcacuuggcggaguauuaauuuuucuaaguacagcaguuucagcagacguaggcuguaguguagauuucagcaaa

SEQ ID NO: 2600 - RNA, 2136 nt, Artificial Sequence
  KU758874.1 prME-long CDS opt
cguauaauaaaugcacgaaaagaaaaaaaaagaagaggagcugacacaucaguuggaauuguaggauuauuauuaacuacagcaauggcagcagaaguaacaagacgaggaucugcuuauuauauguauuuagauagaaacgaugcgggagaagcaauaucauuucccacaacauugggaaugaauaaauguuacauacaaauuauggauuuaggacauaugugugaugcaacaaugagcuaugaauguccaaugcuagacgaaggaguugaaccugaugauguagacuguuggugcaauacuacaucaacaugggucguauauggaacaugccaucacaaaaaaggugaagcuagaagaaguagaagagcaguaaccuuaccaucccacaguacacgaaaacuacaaacaaggagucaaacaugguuagaaucaagagaauauaccaaacaucugauacgaguagaaaauuggauauucagaaacccaggauucgccuuggcagcugccgcgauagcauggcuacuaggaaguucaacuucacaaaaaguaauauacuuagucaugauacuacuuauugcgccagcauauagcauacgauguauaggagucagcaauagagauuuugucgaaggaaugucuggaggaacauggguagacguaguauuagaacauggaggauguguaacaguaauggcacaagauaaaccaacuguagauauugaauuaguuaccacaacaguaucaaauauggcagaaguaagaucauacuguuaugaagcaaguauaagcgauauggcaagugacucaagauguccaacccaaggagaagcauacuuagauaaacaaagcgauacacaauauguauguaaacgaacguuaguagacagaggauggggaaauggauguggucuauucggaaaagguaguuuagugacaugugcaaaauuugcuuguaguaaaaaaaugacaggaaaauccauucaaccagaaaaucuagaauauagaauaaugcugaguguacauggaucacaacacucugguaugauagucaacgacacuggacaugaaacugaugaaaauagggcuaaaguagaaauaacaccuaauucaccaagagccgaagcuacuuuaggugguuuuggcucauuaggcuuagauugugaaccacgaacaggauuagauuuuucagaccuauacuaccuaacaaugaacaacaaacauugguuaguucauaaagaaugguuucacgauauaccacuaccuuggcaugcaggugcagauacuggaacuccacauuggaauaacaaagaagcacuagucgaauuuaaagacgcacaugcaaaacgacaaacaguaguaguuuugggcucucaagaaggugcaguucauacagcacuagcuggugcucuagaagcagaaauggauggagcuaaggguaaacuaaguagcggacauuuaaaaugcagacuaaaaauggauaaauuacgacuaaaaggaguaaguuauucauuaugcacagcggcauucaccuuuacaaaaauaccagcagaaacauuacacggaacaguuacaguugaaguccaauaugcaggaacagauggaccauguaagguaccugcccaaauggcuguagauaugcaaacacuuacaccuguuggaagacuuauuacagcuaaccccguaauaaccgagucaacagaaaacaguaaaaugaugcuagaacuagaccccccauuuggugauaguuauauagugauagggguaggugaaaaaaaaauaacacaucauuggcauaggagcggaucaacaauagguaaagcauuugaagccacaguaagaggugccaaaagaauggcaguguuaggagacacagcaugggacuucggaucagugggcggugcacuaaacaguuuagguaagggaauacaucagauauuuggugcugcauuuaaaucuuuauuuggaggaaugaguugguuuagucaaauuuuaauuggaacacuauuaauguggcuagggcuaaacacgaaaaacggcucaauaucauuaaugugcuuagcauuagguggaguuuuaauauuucuaucaacagcaguuagugcugacguuggaugcuccguagacuucucaaaa

SEQ ID NO: 2601 - RNA, 2136 nt, Artificial Sequence
  KY014314.1 prME-long CDS opt
agaauaauaaacgcuagaaaagaaaagaaaagaagaggagcugauacaagugucgguaucguuggacucuuauuaacaacugcaauggccgcagaagugacacgaagggguagugcauauuacauguauuuagauagaaaugaugcaggagaagcgauaucauuccccacaacacuaggaaugaauaaaugcuauauacaaauuauggauuuaggucacaugugugacgcaacaaugucauaugaauguccaauguuagacgaaggaguagaaccagaugauguagauugcugguguaauacaacaucaacaugggucguauacggaacuugucaccacaagaaaggagaagcuaggagaaguagacgagcaguaacucuaccuagucauucuaccagaaaacuccaaaccagaucacaaacaugguuggaaucaagagaauauacuaaacaccugauaaggguagaaaauuggauauuucguaacccagguuucgcauuagcagcagcagcaaucgcaugguuauuaggaagcagcacaucacaaaaaguaauauauuuagugaugauauuacuaauagcgccugcauauaguauuagauguauaggaguaucaaaucgagacuuuguugaaggaaugucaggaggaacauggguagacguaguucuugaacacggaggauguguaacaguaauggcacaagacaaaccaacgguagauauagaauuaguaacaacgacaguaucaaacauggcagaaguaagaucuuacuguuacgaagcguccauaucagauauggcaagcgauucaagaugcccaacccaaggugaagcauaucuagauaaacaaagugauacacaauauguauguaaaaggacucuagucgacagagggugggguaauggauguggacuauuuggaaaaggaucauuaguaacaugugcaaaauuugcauguucaaagaaaaugaccggaaaaagcauccaaccagaaaaucuugaauaccgaauuaugcuaucaguacauggaucacaacacucaggaaugauaguaaaugacacaggucaugaaacagaugaaaacagggcaaaaguagaaauaacaccaaauucaccuagagcagaagcaacccucggagguuuuggaucauuaggauuagauugugaaccuagaacaggacuagauuuuucagacuuauacuacuuaaccaugaacaauaaacauugguuaguacacaaagaaugguuucaugacauaccuuugccauggcacgcaggagccgauaccggaacaccacacuggaacaauaaagaggcuuuaguagaauuuaaagaagcacaugcaaaacgacaaacaguaguaguauuaggaagucaagaaggggccguacacacagcacuagcaggagcauuagaagcagaaauggauggagcuaaaggaagacuaucaaguggacauuuaaaaugcagacuaaaaauggauaaacuaagacuaaaaggggucagcuacagucuauguacagccgcauuuacauuuaccaaaauaccagcagaaacacuacacggaacaguaacaguagaaguacaauacgcaggaacugacggaccauguaaaguacccgcacaaauggcaguagauaugcagacauuaacuccagucggcagauuaauaacugcaaacccugucauaacagaaaguacagaaaauucaaagaugauguuagaacuagauccacccuucggcgacagcuauaucguuauaggagugggagaaaagaaaauaacacaucauuggcaucgaucagguaguacaauaggaaaggcuuuugaagcaacaguaagaggugccaaaagaauggcuguacuuggagauacagcaugggauuuuggaucaguagguggugcuuuaaauaguuuaggaaaaggaauacaucaaauuuuuggagcagcauuuaaaucauuauuuggaggaaugucaugguucucacaaauauuaauaggaacucuauuaauguggcucggauuaaauaccaaaaaugggucaauaaguuuaaugugccuagcauuaggggguguauuaauauuuuuaucaacagcaguaagugcagauguuggauguucagucgauuuuaguaaa

SEQ ID NO: 2602 - RNA, 2136 nt, Artificial Sequence
  KU926310.1 prME-long CDS opt
cgaauaauaaaugcuagaaaagaaaagaaaagaagaggagcagauacuucaguuggaauaguagguuuacuucucaccacugcaauggcagcagaaguaacacguagaggcucagcauacuacauguauuuagaucgaaaugaugcaggagaagcaauaucauucccaacaacacucggaaugaauaaauguuauauacaaaucauggauuugggacauaugugugaugccacuaugagcuacgaauguccuaugcuagacgaaggaguagaaccugaugauguagauuguugguguaacacuacaagcacauggguaguuuauggcacaugucaucauaagaaaggugaagcaagaagaucaagacgagcgguuacacugccuucucacucuacaagaaaacuacaaacaagaucacaaacuugguuagaaaguagagaauacacgaaacauuuaauaagaguagaaaacuggauuuucagaaaucccggauuugcuuuagcugcagcagcuauagcuugguuauuaggaagcaguacaagccaaaaaguaauauauuuaguaaugauucuacuuauagcuccagcauauucaauaagguguauaggaguuucaaauagagauuuuguagaaggaaugucagguggaacauggguagaugucguucuagaacauggcggaugcguaacagucauggcacaagauaaaccaacaguagauauugaauuaguaacaacaacuguaaguaauauggcagaaguaagaucguauugcuacgaagcaucaauaagugauauggcaucagacucaagaugcccaacacaaggagaagcauaucuagauaaacaaucagacacgcaauauguuuguaagcgaaccuuaguagauagagguugggguaacgggugcggauuauuuggaaaaggcagucuaguaacaugcgcuaaauuugcguguaguaaaaagaugacuggaaaaucaauucaaccagaaaaucuagaauauagaauaaugcugucaguacaugguucacaacauaguggaaugauaguaaaugacacgggucacgaaacagaugaaaauagagcgaaaguagaaauaacaccaaauagcccacgagcugaagcuacauugggagguuucgguucuuuagguuuagacugcgaaccgagaacaggauuagacuucagcgaucuauauuauuuaacaaugaauaauaaacacugguuaguacauaaagaaugguuucaugacauuccauuaccauggcaugcaggagcagauacagguacaccacauuggaacaauaaagaagcauuaguagaauuuaaagaugcacaugcaaaaagacaaacaguaguaguuuuagguagucaagaaggagcaguucacacagcacuagcuggugcauuagaagcugaaauggauggugcgaaaggaagacugaguuccggacaccuaaaaugcagacuaaaaauggacaaacuaagacuaaaagguguaucauacagcuuauguacagcagcauucacauucacaaaaauucccgcagaaacauuacauggaacaguaacaguugaaguccaguacgcgggugcagaugguccuugcaaaguacccgcccaaauggcagucgacaugcaaacuuuaacaccuguaggaagauugauaacagcaaauccaguaauaacagaaucaacagaaaacaguaaaaugauguuggaacuugauccaccauucggugacaguuacauaguaauagggguuggagaaaagaaaauaacacaucauuggcauagaaguggaagcacaauaggaaaagcauuugaagcaacaguaagaggcgcaaaacgcauggcaguacuuggagauacagcuugggacuuugggagcguuggaggagcccuaaacagucuuggaaaaggaauacaucagauauucggagcugcauucaaaagucuauuuggaggaaugucaugguuuagucaaauauuaaucgguacauuauuaauguggcuaggcuuaaauacgaaaaauggaaguauaagucuuaugugucuagcauuaggugguguacuaauauuuuuaaguacugcagugagugcagacguagguuguucaguugacuucaguaaa

SEQ ID NO: 2603 - RNA, 2136 nt, Artificial Sequence
  KU761560.1 prME-long CDS opt
agaauuauaaaugcaggcaaagaaaaaaaaagacgaggugcagauacuaacgugggaauaguaggauuauuacuaacaacagcgauggcagccgaaguaacuagacgaggaagcgcauauuauauguaucuagaucgaaaugaugcgggagaagcaauaaguuucccaacaacauuaggaaugaacaaaugcuauauacaaaucauggaucuuggacacaugugugaugcaacaaugagcuaugaauguccaauguuagaugaaggaguugaaccugaugacguggauuguuggugcaacacgacaucaacauggguaguauauggaacaugccaucacaaaaaaggcgaagccagaagaagcagaagagcaguaacguuaccuagucauagcacaaggaaauuacaaacaagaagucaaacuuggcuugaaucaagagaauacacaaagcaucucaucagaguugaaaacuggaucuuucgaaauccaggauuugcuuuagcagccgcagccauagcaugguuacuaggaucaucaacaagucaaaaaguaauauacuuggucaugauacuacuaauugcaccagcuuauaguauacguugcauaggaguaaguaacagggauuuuguagaaggaaugucuggaggaacauggguugauguaguccuagaacacggaggauguguuacgguaauggcacaagauaaaccaacaguagauauagaauuaguaaccaccacaguuucaaauauggcagaaguacgaucguauuguuacgaagcuaguauaagugacauggcaucagauucaagaugcccaacacaaggagaagccuauuuagauaaacaaagugacacacaauacguauguaaaagaacacuaguagauaggggauggggaaaugguugcgguuuauuugggaaggguaguuuaguaacgugugcaaaauuugcauguaguaaaaagaugacuggcaaaagcauccaaccugaaaauuuagaauauagaauaauguuaucaguacauggaagucaacacucaggaaugaucguaaacgauacuggacacgaaacugaugaaaaucgagcaaaaguagaaauuacaccaaacucuccacgagcagaagcaacauuaggaggauuuggaucauuaggccuagauugcgaaccccgaacaggacuagauuucagcgauuuauauuauuuaacaaugaauaauaaacauugguuaguacauaaagagugguuucaugacauaccucuaccguggcaugcaggagcagauacugguacaccacauuggaauaauaaagaagcacuggucgaauucaaagaugcacaugcaaaacgacaaacaguaguaguauuaggcagucaagaaggagcgguacauacagcacuagcaggagcccuagaagcagaaauggacggugcaaaaggaagauuaaguaguggacaucugaaauguagauuaaaaauggauaaacuaagauuaaaaggagucucauauucauuauguacagcagcauuuacauuuacaaaaauacccgccgaaacauuacauggaacaguaacaguggaaguacaauaugcuggaacagauggaccuuguaaaguuccagcucaaauggcaguagacaugcaaacauuaacacccguagguagacuaauuacagcaaacccuguaauaacagaaagcacagaaaacucaaaaaugaugcuagaauuagaucccccauuuggugauaguuauauuguuauaggaguuggagaaaaaaaaauaacacaucauuggcacagauccgguucgacaauuggaaaagcauuugaagcuacuguaagaggugcaaggcggauggcgguauugggagacacugcuugggacuucggaucaguuggaggagcacuaaacucacuaggaaaagguauacaucaaauuuuuggugcagccuuuaaaucauuauucggaggcauguccugguucucacaaauacuaauagguacacuucuaaugugguuaggacuaaauacgaaaaauggaucaauaagcuuaauguguuuagcccuagggggaguccuaauauucuuaucaacugcaguaucagcagauguagguuguaguguagauuuuucuaaa

SEQ ID NO: 2604 - RNA, 2136 nt, Artificial Sequence
  KY317939.1 prME-long CDS opt
agaauaauaaaugcaagaaaagaaaaaaaacgccgaggagcagaaacuaguguagggauaguagguuuacuuuuaacaacagcaauggcagcagaaguuacaagaagaggaagugcuuauuauauguauuuagaccgcaaagaugcaggagaagcaauaaguuuucccacaacguuggguaugaauaaauguuacauacaaauuauggacuuaggacacaugugcgaugcaacuaugagcuacgaaugcccuaugcuagaugaaggggucgaaccagaugacguugauuguugguguaacacaacaucaacauggguagucuaugguacaugccaucauaaaaaaggugaagcucgacgaucaagaagagcaguaacacuaccuagucauaguacuagaaaacuacaaacaagaagucaaacauggcuagaaaguagagaguauacaaaacaccuaauaagagucgaaaauuggauuuuuagaaacccaggauuugcauuggcggcagcugcuauugcaugguuacuaggaaguucaacuucacaaaaaguuauauaucuaguaaugauacuauuaauagcaccugcguauucaauuagauguauaggaguuucgaauagagauuuuguagaagggaugucagguggaacauggguagacguaguacuagaacacggaggauguguaacagucauggcacaagauaaaccaacaguugacauagaauuaguaacaacaacaguuaguaauauggcagaagucagaucauauugcuaugaagccagcauaucugauauggcaagcgacucaagauguccaacacaaggugaagcguaucuugauaaacaaucagauacccaauauguauguaagcgaacauuaguagauagaggguggggaaauggaugcggacuguuuggaaaaggaagucuagugacaugcgcaaaauucgcauguucaaaaaaaaugacaggaaaaagcauacaaccggaaaauuuagaauauagaauaauguuaaguguacaugguucacaacauaguggaaugauagucaaugauacuggacacgaaacagaugaaaaucgagcaaaaguugaaauaaccccuaauucaccaagagcagaagcuacauuaggagguuuuggaagucuaggauuagacugugaaccaagaacagggcuagacuuuagcgauuuauauuauuuaacaaugaauaauaaacauugguugguacauaaagaaugguuucacgacaucccacuaccguggcaugcuggagccgacacugguacaccacauuggaauaauaaggaagcauuaguagaauuuaaagaugcacacgcaaaaaggcaaacaguuguagucuugggcagucaggagggagcaguucauaccgcucuagcuggagcauuagaagcagaaauggauggagcaaaagguagauuaucaucuggacaccuaaaauguagacuuaaaauggacaaauugagacuuaaaggugucucauauuccuuauguacagcugccuuuacauuuacaaaaaucccagcugaaacauuacauggaacagugacaguggaaguacaauacgcaggaacagauggaccuuguaaaguuccagcacaaauggcaguugauaugcaaacacuaacaccaguuggcagauuaauuacggccaacccagugauaacagaaaguacagaaaauucaaagaugauguuagaacuagauccuccuuuuggagauucauauauugucauaggaguaggagaaaaaaaaauaacucaucauuggcauagaucaggaucaacaauaggaaaagcauucgaagcaacaguuagaggagcuaaaaggauggccguacuaggagacacagcaugggauuuuggaucagugggaggagcauuaaacucauugggaaaagggauacaccaaauuuuuggcgcagcauuuaaaucuuuauuugggggcaugucuugguucagucaaauauuaauuggaacacugcucauguggcuuggacuuaauacaaaaaacggaucaauaagcuuaaugugucuugcauuaggaggaguucuaauauuuuuaaguacugcaguaucugcagauguaggauguaguguggauuucaguaaa

SEQ ID NO: 2605 - RNA, 2136 nt, Artificial Sequence
  KY075937.1 prME-long CDS opt
agaauaauaaacgcaagaaaggaaaaaaaaagaagaggagcagauacaaguguaggaauaguaggcuuacuacuuaccacagcaauggcugccgaaguaacaagaagaggaucagcauauuacauguauuuagauagaaacgaugcaggagaagcaaucucuuuuccaaccacacucgggaugaacaaauguuacauacaaauaauggacuuaggacauaugugugaugcaacuaugaguuaugaauguccuaugcuagaugagggggucgaaccugaugauguugauuguugguguaauaccacuagcacauggguaguguaugguacaugucaucacaaaaaaggugaagcaagaagaucaagaagagcaguaacauuaccaagucauagcaccagaaaauuacaaacaagaucgcaaacaugguuagaaaguagagaauauacuaaacaucuaauaaggguagaaaacuggauauuuagaaauccaggcuuugcauuagcagcggcugcaaucgcaugguuacuagguaguucaacaucacaaaaaguuauauaucuaguuaugauacuauuaauagcaccagcauacucaauaagaugcauaggaguaaguaauagagauuucguagaagguaugagugggggcacauggguugacguuguuuuagaacaugguggauguguuacuguaauggcacaagacaaaccaacuguagauauagaacuaguaacgacaacaguaucaaacauggcugaagugagaucauauuguuaugaagccaguauaagugauauggucagugauucaagauguccaacacaaggugaagcauauuuagauaaacaaucagacacucaauacguuuguaaaaggacucucguagacagaggauggggaaacggauguggauuauuugguaaagggucuuuaguaacaugcgcaaaauuugcguguagcaagaaaaugaccggaaaaaguauucaaccugaaaauuuagaguauagaauuaugcuaaguguacacggaagucaacauucagguaugauaguuaacgauacaggucaugaaacagaugaaaauagagcuaaaguagaaauaacaccaaauucacccagggcagaagcaacauuagggggcuucggaucauuaggacuagauugugaaccucgaacugggcucgauuuuagugaucuuuauuauuugacaaugaauaauaaacacuggcuugugcauaaagaaugguuucacgauauaccauuaccauggcacgccggagcggauacaggaacuccacauuggaacaacaaagaagcauugguagaauuuaaagacgcccaugcuaaaagacaaacagucguaguacuaggaucucaagaaggugcaguacauacagcgcuagcaggagcguuagaagcggaaauggauggugcuaaaggaagauuaagcagcggacaucugaaaugcagauuaaaaauggacaaauuaagauuaaaaggagucucauauucauuauguacagcugcauuuaccuucacaaaaauaccagcagagacuuugcaugguacaguaacaguagaaguacaauaugcuggaacagacggucccuguaaaguaccugcacaaauggcgguagauaugcaaacacuaacucccguaggaagacuaauaacagcuaauccgguuauaaccgaaaguacugaaaauagcaaaaugauguuagaauuggacccaccauuuggagauaguuauauuguuauagguguaggcgaaaaaaaaauaacucaccauuggcauagaagugguaguacaauaggcaaagcauucgaagcaacuguaagaggagcaaaaagaauggcuguacuaggcgauacagcaugggauuucgguagcguaggaggagcacuaaacucuuuagguaaagguauucaccaaauauuuggugcagcauuuaagucccuauucggaggaaugagcugguuuagucaaaucuuaauaggaacucuacuaaugugguuaggacuaaauacaaaaaaugguaguauaaguuuaaugugcuuagcacuuggaggaguauuaauuuuucuaagcacagcaguaucagcagacguuggaugcucuguagauuucucaaaa

SEQ ID NO: 2606 - RNA, 2136 nt, Artificial Sequence
  LC191864.1 prME-long CDS opt
agaauuauaaaugcccgaaaagaaaagaaaagaagaggagcagauacaaauguagguauagucggccuacuacuaacaacagcaauggcagcagaaguuacacgccguggaucagcuuauuauauguaccuagauagaaaugaugcaggagaagcgauuaguuuuccgacaacauuagguaugaauaaauguuacauacaaauaauggaccugggacacaugugcgacgcuacaaugagcuaugaaugcccaaugcuagacgaaggaguagaaccagaugacguagacugcugguguaauaugacaucaacaugggucguauauggaacaugccaucauaagaaaggagaagcaagaagaucucggagagcgguaacucucccaagucauaguacuagaaaacuacaaacaagaucucaaaccuggcuagaaucaagagaauauacuaaacaucuaauaagaguagaaaauuggauauuuagaaacccugguuucgcccuagcagcugcugcaauagccuggcuacuaggaaguaguacaagccaaaaaguaauauauuuaguaaugauauuacucauugcuccggcguauaguauuagauguauuggaguaaguaauagagacuucguagaaggaaugucgggaggcacauggguagauguaguacuagaacauggaggauguguaacgguuauggcucaagauaaaccaacaguagauauagaauuagucacuacaacaguaucaaauauggcagaaguaagaucuuacuguuaugaagcaucaauaagugauauggcuagcgacucuagaugcccaacccaaggagaagcauacuuagauaaacaaucagauacacaauauguauguaaaagaacauuaguagacagaggguggggaaauggauguggauuauucggaaaaggaucccuaguaacaugcgcaaaauuugccuguucaaagaaaaugacaggaaaaucaauacaaccagaaaacuuagaauauagaauaauguuaaguguacacgguucacaacauucaggaaugauaguaaaugauaccggucaugaaacugaugaaaauagagcaaaaguggaaaucaccccaaauucaccaagggcagaagccacucuaggaggguuugguucacuaggacuugauugugaaccaagaacaggacuagauuuuucagauuuauauuauuuaaccaugaauaauaaacauugguuaguucauaaagaaugguuucaugauauuccccuuccauggcaugcaggagcagacacaggaacaccucauuggaacaacaaagaagcucuaguagaauuuaaagaugcacacgcaaaaagacaaacuguagucguucuaggaucacaagaaggagcaguacacacagcacuagcaggagcacucgaagcagaaauggauggagcaaaaggacgacuaagcaguggacauuuaaaaugucgacuuaaaauggauaaauuaagauuaaaaggaguaaguuacucauuauguacagcagcauuuacauucacaaaaauacccgcagaaacccuacauggaacaguaacuguggaaguccaauacgcuggcacagauggaccauguaaaguaccagcucaaauggcaguagacaugcaaacauuaacuccaguagguagauuaauaacugcaaauccugucauaacagaaucaacggaaaacuccaaaaugauguuagaacuagacccaccauuuggagacaguuauauaguuauagguguaggugaaaagaaaauuacacaucauuggcauagaaguggaucaaccauaggaaaagccuuugaagcaacaguaagaggagccaaaaggauggcaguacuuggagacacagcaugggacuuuggaagcguaggaggagcauuaaacagccugggaaaaggaauacaucaaauauucggagcagcauuuaaaagccuuuuuggagguaugucgugguucucccaaauccuaauuggaacucucuuaauguggcuaggacuuaauaccaaaaacggaucaauaucauuaaugugucuagcauuaggagguguacuaauauuucuaaguacagcaguaucagcagacguaggauguucaguagacuucucaaaa

SEQ ID NO: 2607 - RNA, 2136 nt, Artificial Sequence
  KX447517.1 prME-long CDS opt
agaauaauaaacgcuaggaaagaaaaaaaaagaagaggggcagacacaaguguagggauagucggacuauuauuaacuacagcaauggcagcagaaguuacaaggagagguucugcauacuauauguauuuagaucgaaaugacgcaggcgaggcuauaaguuuucccacaacucucggaaugaauaaauguuauauucaaauaauggaucuuggacacaugugugaugcaaccaugucauaugaauguccaauguuagaugaaggaguagagccagacgauguagacuguugguguaacacuacaucaacuuggguaguuuacggaacaugucaucauaaaaaaggagaagcgagaaggaguagaagagcaguaacauuaccuucacauucaaccaggaaauuacaaacaagaagccaaaccugguuagaaucaagagaauauacaaagcauuuaauacgcguggaaaacuggauauuuaggaacccaggcuucgcuuuagcagcggcugcgauagcauggcuccucggaucaucaacgucacaaaaaguaauauauuuaguaaugauuuuauugauagcaccagcauauucaauacgauguauuggcgugucaaaucgagauuuuguugaaggaauguccggaggaacuuggguagauguaguauuagaacauggaggauguguaacaguaauggcacaagacaaaccuacaguugauauagaauuaguaacaacaaccguaucaaauauggcagagguaagaagcuauuguuaugaagcuucaauaucagauauggcuucagauagcagauguccaacacagggagaagcuuaucuagacaaacaaucagacacacaauauguauguaaaaggacacuaguagauagagguuggggaaaugguuguggucuuuucgguaaaggaagcuuaguaaccugcgcaaaauuugcuuguaguaaaaaaaugacuggaaaaagcauucaaccagaaaauuuagaauauagaauaauguuaaguguacacggcucucagcauagcggaaugauaguaaaugauaccggccacgaaacugacgaaaauagagccaaagucgaaauuacuccuaauucuccaagggcugaagcugcauuaggugguuuuggaucgcuaggccuugacugcgaaccaagaacaggauuagacuucagugaucuauauuauuuaaccaugaauaauaaacacugguuaguccauaaagaaugguuccaugauauaccgcuaccauggcacgcaggugcagauacagguaccccacacuggaauaauaaggaagcauuagucgaauuuaaagaugcacacgcgaaaagacaaacaguaguaguauuaggaucacaagaaggggcuguacacacagcacuagcuggagcacuagaagcagaaauggauggugccaaaggcagauuaaguaguggacaucuuaaauguagacuuaaaauggauaaauuacgacuuaaagguguaaguuauucacuauguacagcagcauuuacuuuuacuaaaauuccagcagaaacacuucauggcaccguaacuguugaaguacaauacgcaggaacugaugguccuuguaaaguuccagcacaaauggcaguggauaugcaaacauuaaccccaguaggcagauugauaacugcaaauccgguaauuacagaaaguacagaaaacaguaaaaugaugcuugagcuugauccaccauuuggggacucuuacauaguaauaggagucggugaaaaaaaaauaacacaccacuggcacagaucagguucaacuauaggaaaagccuucgaagcuacaguaagaggugcaaaaagaauggcaguauuaggagauacagcaugggacuucggaucuguaggaggagcauuaaauucauuaggaaaaggaauacaucaaaucuucggagccgcauuuaaaagucuauucgguggaaugucuugguuuagccaaacauuaauaggcacuuuauuaauguggcuagguuuaaauacaaaaaaugguucaauuaguuuaauguguuuagcauuaggagguguacuaauauucuugaguaccgcaguaucagccgaugucgguuguucuguagauuuuagcaaa

SEQ ID NO: 2608 - RNA, 2136 nt, Artificial Sequence
  KU922923.1 prME-long CDS opt
aggauuauaaacgcacgaaaagaaaaaaaaagaagaggggcagaaacaagcguaggaauuguaggucuacuauuaacaacagcuauggcugcugaaguaacacgaagaggaucagcauauuacauguauuuagauagaaaugaugcgggagaagcaaucucauucccuacaacguuagggaugaauaaauguuauauccaaauaauggaucuaggccacaugugcgaugcuacaauguccuaugagugcccaaugcuagaugaaggaguagaaccagaugauguagauuguugguguaauacaacaaguacauggguaguauaugguacaugucaccacaaaaaaggagaagcgaggcggucaaggagagcaguuacauuaccaucacacaguacaagaaaacuacagacacgaucacaaacaugguuggaaaguagggaauacacuaaacaucuaauacguguugaaaauuggaucuuuagaaacccaggguucgcucuagcagcggcagcuauagcaugguuacuagguucuucaacaucgcaaaaaguaauauaccucguaaugauucuacuaauagccuuagcuuacucaauaagaugcauaggcguauccaauagagauuuuguagaaggaaugucaggaggaacuuggguagauguaguuuuagaacacggaggcuguguaacaguaauggcacaggacaaaccuacaguagauauagaauuaguaacaacaacaguaucuaauauggcagaaguucgaucauauuguuaugaagcaucgauuucagauauggcaagcgauaguagauguccuacgcaaggugaagcauauuuagauaaacaaucugauacucaauauguaugcaaaagaacauuaguagauagggguuggggaaauggauguggacuauucggaaaaggaagcuuggucacuugugcaaaauuugcauguucaaaaaaaaugacaggaaaaucaauacaaccagaaaacuuagaauacagaauaaugcugagcguacauggaagccaacauagcggaaugauaguaaacgacacaggacaugaaacagaugaaaacagagcaaaaguagaaauaacucccaauucaccaagagcagaagcaacucucggaggauucggaagcuuaggacuagacugugaaccgagaacaggucuagacuucucugaucucuacuaucuaacuaugaauaacaaacauuggcuaguucauaaagaaugguuccaugacauaccauuaccauggcaugcuggagccgauacaggaacaccacauuggaacaauaaagaagcucuaguugaauuuaaagaugcacaugcaaaaagacaaaccgucguuguauuaggaucacaagagggagcuguccauacagcauuagcaggagcauuagaagccgaaauggauggagcaaaaggaagacuaucaucaggacauuugaaauguagauuaaaaauggauaaauuaagacuaaaagggguaucauacucacuauguaccgcagcauuuacauuuaccaaaauaccagcagaaacauuacauggaacaguuacaguggaaguccaauaugccggaacugaugguccaugcaagguacccgcccaaauggcaguagacaugcaaacacuaacaccagugggaagauuaauaaccgccaauccaguaauuacagaaucaacagaaaauucaaaaaugaugcucgaauuagauccgccauucggagauagcuacauuguuauuggaguaggagaaaaaaaaauuacacaccauuggcaccgaagcggaagcacuauuggaaaagcauuugaagcuacuguaagaggagcaaaacgaauggcaguacuuggagauacugcuugggauuuuggaaguguagguggcgcacuaaacagcuuagguaaaggaauacaucaaauauucggcgccgcauucaaaagcuuguuugggggaaugucaugguucucacaaauauugauagguacacuuuugauguggcuaggacuaaauacaaaaaacgguucaauaagucuuaugugucuagcccucgguggaguacuuauauuuuuaaguaccgcaguaagcgcagauguuggcuguaguguagacuuuucaaaa

SEQ ID NO: 2609 - RNA, 2136 nt, Artificial Sequence
  KY003156.1 prME-long CDS opt
agaauaauaaaugcgagaaaagaaaaaaaaagaagaggagcugauacaaguguuggaauugugggucucuuauuaacaacagcaauggcagcagaaguaacaagaagagggucagcauacuauauguaucuagauaggaaugaugccggcgaagcuauaucauuuccuacaacauuaggaaugaauaaaugcuauauacaaauaauggaucuuggucauaugugugaugcaaccaugaguuaugaauguccgauguuggacgaaggaguugaaccagaugauguagacugcugguguaauacaacaaguacaugggucguauauggcacaugucaucauaaaaaaggagaagcgagaagaucgcguagagcuguaacacuaccaucacauaguaccagaaaacuacaaacgagaagucaaacauggcuagaaucaagagaauauacaaaacacuuaauacgaguagaaaauuggauauuuagaaacccaggauucgcauuagcagcagcggcaauugcaugguuauuaggaucaaguacgagucaaaaaguaauauauuuaguaaugauacuauuaauagcaccugcauacucaauaagauguauaggaauaaguaaucgagauuucguggaaggaaugucaggagguacauggguagauguaguucuugaacauggaggauguguaacuguaauggcccaagacaagccaacaguagauaucgaauugguaacaacgacaguuaguaauauggcagaaguacgaaguuauuguuacgaagcaucuauuucugauauggcaucagacaguagauguccaacacaaggagaggcuuaucuggacaaacaaagugacacacaauauguauguaaacguacgcuaguugaucgaggauggggaaacggauguggguuauucggaaaagggaguuuaguaacaugugcaaaauuugcauguucgaaaaagaugacgggaaaaagcauacaaccagagaauuuggaauauagaauaaugcuaagugugcacggaucacaacacucagguaugauagucaaugauacuggacaugaaaccgaugaaaaucgugcaaaaguagaaauuacaccaaauaguccaagagcagaagcaacacuaggcggauucgggauauuaggauuagauugugaaccaagaacaggacuagauuuuagcgaucuauacuacuuaaccaugaauaacaaacauugguuaguacauaaagagugguuccaugauaucccucuuccauggcacgcuggugcagauacaggaacaccacauuggaacaacaaagaagcacuaguagaauuuaaagaugcacacgcaaaaagacaaacaguaguaguauuaggaagccaagagggagcaguacauacagcacuagcaggugcauuagaagcagaaauggacggagcgaaagguagauugaguaguggacauuuaaaaugcagauuaaaaauggacaaacuaagacuuaaaggaguaaguuacagucuuuguacagcagcauuuacuuucacaaaaauaccagcugaaacacuucauggaacaguuacuguagaaguucaauaugcagguacagauggaccauguaaaguacccgcacaaauggcaguagauaugcaaacccugacaccaguaggcagacuaauaacagcgaacccaguaauaacagaaagcaccgaaaacucaaaaaugaugcuagaauuagacccaccauuuggagacaguuauauaguuauagguguuggagaaaaaaaaauaacacaucacuggcacagaagugguaguacaauaggcaaagcauuugaagcuacugucagaggcgcaaaaagaauggccguauuaggagauacagcaugggacuuugggagcguuggaggugcauugaauagccucgguaaagggauccaucagauauuuggagcagcauuuaaaagcuuauucggaggaaugucaugguucucacaaauauuaauugguacauuauuaaugugguuagguuugaacacaaagaaugguucaauuucauuaaugugcuuagccuuaggaggaguauuaauauuucuuaguacagcaguaucggcugauguuggauguuccguagauuuuaguaaa

SEQ ID NO: 2610 - RNA, 2136 nt, Artificial Sequence
  KU312313.1 prME-long CDS opt
agaauaauaaaugcaagaaaagaaaagaaaagaagaggagcagauacaaguguaggaauagugggucuauuauuaacgacugcaauggcagccgaagugacaagacgaggaagcgcauauuauauguaucuagauaggaaugaugcuggagaagcaauuucauuuccaaccacuuuaggaaugaauaaaugcuauauucaaauaauggaucuaggacauacaugugaugcaacaaugaguuaugaauguccaauguuagaugaaggcguagaaccagaugacguagacuguugguguaauacuacaaguacuuggguagucuauggaacaugccaucauaagaaaggagaagcucgacggucacguagagccguaaccuuaccuucucacucaauaagaaaauuacaaacacgaagucaaacauggcuagaaagcagagaauauacaaaacaucuaauacgagucgaaaauuggauauuucgaaauccgggauuugccuuagccgcggcagcaauagcgugguuacucgguaguucaacaucacaaaaaguaauuuacuugguaaugauacugcuuauagccccagccuacucaauaagauguauaggaguaaguaauagagauuuuguugaaggaaugucaggcggaacuugggucgauguaguauuagaacacggcgguugugugacaguuauggcccaagacaaaccaacaguagauauagaauuaguaacaacuacaguauccaauauggcagaaguaagaaguuauuguuaugaagcaucaauaucggauauggcauccgauaguagaugucccacacaaggagaagcauaucuagauaaacaaucagacacacaauauguauguaaacgcaccuuaguagacagagguuggggaaacggauguggauuauuuggaaaaggaagucucgugacuugcgcuaaauuugcauguagcaagaaaaugacaggcaaaaguauacagccagaaaauuuagaauauagaauaauguuaaguguacauggaagucaacauaguggaaugauuguaaaugauacaggacaugaaacagaugaaaacagagcaaaagucgaaauaacaccaaacucaccacgagcagaagccacacuaggaggauuuggaagccuaggcuuagauugugaaccaagaacaggacuagacuuuucagauuuguacuauuuaacuaugaauaauaaacacuggcuaguucauaaagaaugguuccaugacauaccauuaccauggcacgcuggugcagauacagggacaccacacuggaauaauaaagaggcuuugguagaauuuaaagaugcucacgccaaaagacaaacaguaguaguauuaggaucacaagaaggagcuguacauacagcauuagcuggugcguuagaagcagaaauggauggagcaaaaggucgauuaagcucaggacacuuaaaauguagauuaaaaauggacaaauuaagacuaaaagguguaucauauagucuaugcacagcugcauucacauucacaaaaauacccgccgaaacacuucaugguacagucacagucgaaguccaauaugcaggaacugauggaccaugcaaaguaccugcgcaaauggcuguagacaugcaaacgcuaacuccaguaggaagauuaauaacagcaaauccagucauuacugaaucaacugaaaauaguaaaaugaugcuagaauuagauccaccauuuggugauuccuauauaguaauaggcguaggugaaaagaaaauaacucaucauuggcacagaagugggucaacuauaggaaaggcuuucgaagccacaguaagaggugcaaaaagaauggcaguauuaggagacacagcaugggacuuuggaaguguaggaggagcauuaaacagucuagguaaaggaauacaucaaauauuuggagcagcauucaaaucauuauucggcggaaugagcugguuuucacaaauauuaauaggaacccucuuaaugugguuaggacuaaaugcuaaaaauggaucaauuucacuuaugugucucgcacuaggaggaguccuaauauuuuugucgacagcaguaucagcagauguagguuguucuguggacuuuucaaaa

SEQ ID NO: 2611 - RNA, 2136 nt, Artificial Sequence
  KY075935.1 prME-long CDS opt
agaaucaucaaugcuagaaaagaaaaaaaaagacgcggggcagauacaaguguuggaauuguaggauuguuacuaacaacagcaauggcagcagaaguaacaagacgagggagugcauauuacauguaucuagauaggaaugaugcaggggaagcuauaagcuuuccaacaacucuagguaugaauaaaugcuauauacaaauaauggaccugggucauaugugugaugcaacaaugagcuaugaauguccaauguuagaugaaggaguagaaccagaugacguagacuguuggugcaauacaacaaguacauggguaguauauggaacaugucaucauaaaaaaggagaagcacaacgaagcagaagagcuguaacacuaccaagccacucuacuagaaaauuacaaaccagaucacaaacguggcuggaaucacgugaauauacaaaacaucuuauuagaguagaaaauuggauauucagaaauccgggguuugcauuagcagcagcugcaauagcaugguuacuagguaguucuacuucccaaaaagucauauacuuaguuaugauauuauuaauagcaccagcuuacagcauacgauguauaggcguuaguaauagggauuuuguagaagguaugucaggaggcacauggguagauguaguuuuagaacacggcggaugugucacuguaauggcgcaagacaagccaacaguagacauagagcuuguuacaacaacgguaucaaauauggcagaagugaggucauauuguuacgaggcaucaauaagugauauggcaucagauucaagauguccaacacaaggagaggccuauuuagauaaacaaagcgauacacaauacguaugcaaaagaacacugguugauagaggauggggaaauggauguggacuguuuggaaaaggaaguuuagugacaugcgcgaaauuugccuguuccaaaaaaaugacaggaaaaagcauacaaccagagaauuuagaauauagaauaauguuaagugugcacggaagucaacacaguggaaugauuguaaaugacacaggucacgaaacagaugaaaauagagcuaaaguggaaauaacgccuaauucaccaagggcagaagcaacauuaggaggauucggaaguuuagggcuagacugugaaccaaggacaggguuagauuuuagcgaucuguauuaucugacgaugaacaacaaacauugguuaguacauaaagaaugguuccacgauauaccauuaccguggcaugccggagcagacaccggcacaccacauuggaauaauaaagaagcauuaguagaauuuaaagacgcacaugcaaaacgucaaacaguaguaguucuaggaagucaagaaggugcaguacacacugcauuagccggagcacuagaggcggaaauggacggagcaaaaggucgacuuucaaguggucaucuaaaauguagauuaaaaauggacaaacuucgacuaaaaggaguaucuuauaguuuaugcacagcagcauucacauuuacgaaaauuccagcagaaacauuacauggaacagugacuguagagguacaguacgcgggaacagauggaccauguaaagugccagcacaaauggcaguugacaugcaaacauugacaccaguaggacgacucaucacagcaaaucccguaauaaccgaaucaacggaaaauucaaaaaugauguuggaauuagacccaccauuuggggacaguuauauuguaauaggaguuggagaaaaaaaaauuacucaucacuggcacaggagcggaucaacaauagguaaagcguucgaagcaacuguucgaggagccaaacgaauggcaguauuaggagauacagcaugggauuuugguucaguaggaggagcauuaaacaguuuaggaaaaggaauacaccaaauauuuggagcggcauuuaagucauuguuuggagggaugucaugguucucacaaauacuaauaggaacacuguuaaugugguuaggauuaaauaccaaaaacggcaguauuaguuuaaugugcuuagcacuaggaggaguguuaauauucuuaaguacugcuguaagugccgauguaggcuguagugucgacuuuagcaaa

SEQ ID NO: 2612 - RNA, 2136 nt, Artificial Sequence
  KY014320.1 prME-long CDS opt
agaauaauaaacgcaagaaaagaaaaaaagagaagaggagcagauaccaguguagguauuguaggucuguuauugacaacagcuauggcagcagaaguaacaagaagaggaagugcuuauuacauguauuuagauagaaaugaugcaggagaagcaauaucauucccaacaacauuaggaaugaauaaaugcuauauacagauaauggacuuaggacacaugugugaugcaacuaugucguaugaauguccaaugcuagaugaaggaguagaaccggaugauguugauugcugguguaauacaacgucaacauggguaguuuauggaaccugucaucauaagaaaggggaagcuagacguucaagaagagcaguaacccuaccaucacacagcacgcgaaaauuacaagcaagaucacagacuugguuagaaucacgagaauauacgaaacacuuaauacgaguagagaauuggauauuuagaaauccaggauuugcauuagcagcagccgcuauagcaugguuacuuggaucaucaacaucccaaaaaguaaucuaccuaguaaugauacuauuaauagcaccagcuuauaguauuagauguauaggaguaaguaauagagauuuuguugaaggaaugagugguggaacguggguagauguaguauuagaacauggcggauguguaaccguuauggcacaagacaaaccaacaguggacauagaacuaguuacaacaacuguaagcaacauggcggaaguaaggucauauuguuacgaagcuagcauaagugacauggcaucagauaguagauguccaacacaaggcgaagccuaucuagauaaacaaucagacacacaauauguauguaagagaacacuuguagaucguggauggggaaacgguuguggauuguuugguaaaggaucacuaguuacuugugcaaaauucgcauguaguaaaaaaaugacgggaaaaagcauacaaccagaaaauuuagaguacagaauaaugcugaguguucaugguucacaacauucaggaaugauaguaaacgauacaggucacgaaacugaugaaaacagagcgaaaguagaaauaacuccaaauaguccuagagccgaagcaacuuuaggcgguuuugguucauuaggauuagacugugaaccaagaacuggauuagauuucucugauuuauacuacuuaacuaugaauaauaaacauuggcuaguccauaaagaaugguuucaugacauaccauuacccuggcacgcaggugccgacacagguacaccacauuggaauaauaaagaagcauuaguugaauuuaaagaugcacaugcaaaaagacaaacaguaguaguauuagggagucaagaaggagcaguacauacagcuuuagcaggggcauuggaagcagaaauggauggcgcuaaagguagacuaucaucuggacacuuaaaaugucgacuaaaaauggauaaauuaagacuuaaaggaguaaguuauagccuaugcacggcagcguuuacauuuacaaaaauaccugcugaaacuuuacauggcacaguuacaguagaaguacaguaugcgggaacagauggucccuguaaaguaccagcucaaauggcuguagauaugcaaacguuaacaccaguaggcagauuaauaacagcaaacccaguuauaacagaaaguaccgaaaauagcaaaaugauguuggaauuagauccaccuuuuggagauucauauauaguaauaggaguuggagaaaaaaaaauaacacaucauuggcauagaaguggaucaaccauaggcaaagcuuuugaggcaacaguaaggggagcaaaacgaauggcaguauuaggagauacagcaugggauuuugguucaguaggaggagcacucaauagucuuggcaaaggcauacaucagauauuuggagccgcuuucaaaucauuauuuggugggaugucaugguucucacaaauucugauaggaacacuguuaaugugguuaggccuuaauacgaaaaauggaucaauuagcuuaaugugcuuagcauuaggaggaguacuaauuuuuuuaucaaccgcaguaagcgcugauguagggugcaguguagauuuuucaaaa

SEQ ID NO: 2613 - RNA, 2136 nt, Artificial Sequence
  KX827309.1 prME-long CDS opt
agaauaauaaaugcacgaaaagagaagaaaagacggggcgcagacacaagugucggaauuguaggauuacuucuaacaacagcaauggcagcagaaguaacaagaagaggaagugcauauuauauguaucuggauagaagcgaugcaggagaagcaauuagcuucccaacaacguuagguaugaauaaaugcuacauacaaauaauggauuuaggacauaugugcgacgcaacaaugaguuacgaauguccaaugcuggaugaaggaguagaaccagacgauguggauuguuggugcaacacuacaaguacuugggugguauauggaacuugccaucacaagaaaggugaagcaagaagaucaaggagagcuguuacguuaccaucacacaguacaagaaaauuacaaacaagaagucaaacauggcuggaaaguagagaauacacaaaacacuuaauaagaguugaaaauuggaucuuuaggaacccaggauuugcacuagcugcagcagcaauagccuggcuacuagguaguaguacaagccaaaaaguaauauauuuagucaugauccuauuaauagcaccagcauacucuauaagauguauaggaguaagcaauagagauuucguagaaggaaugucuggaggaaccuggguagauguaguuuuagaacacggaggcugcguaacaguuauggcccaagauaaaccgacaguugauauagaacuuguaacaacaacgguaaguaauauggcagaaguaagauccuacuguuacgaagcaaguauaagugacauggcuucagauucaagauguccaacacaaggggaagcguaccuugauaaacaaucugauacacaauauguuuguaaaagaacccuaguagauagagguuggggaaauggauguggacuuuuuggaaaagggaguuuaguuacaugugcaaaauucgcauguaguaagaaaaugacagguaaaaguauacaaccagaaaauuuggaauacaggauaauguuaaguguccauggaagucaacauagcggaaugauagucaaugauacggggcaugaaacagacgaaaacagagcaaaaguagaaauaacaccuaauuccccgcgagcagaagcaacauuagguggauuuggcucauuaggauuagauugcgaaccaaggacuggauuagauuuuagugauuuguauuauuuaacaaugaacaauaaacauuggcuuguucauaaagaaugguuucaugauauuccacuaccauggcacgcaggagcugauacaggcaccccacauuggaauaauaaagaagcauuggucgaauuuaaagaugcucaugcaaaaagacaaacgguaguaguauuaggaucacaagaaggagcaguacauacagcacuugcuggugcuuuagaagcagaaauggauggagcaaaaggucgauuaaguaguggacauuuaaaauguagauuaaaaauggacaaauugagacuaaaaggugucuccuauagcuuaugcacagcagcauuuacauuuacaaaaaucccagcagaaacauuacauggaacuguaacuguugaaguacaauaugcagguacagauggcccguguaaaguuccagcucagauggcuguugauaugcaaacauuaacaccugucggaagauuaauaacggcaaaucccguaaucacggaaaguacugaaaauaguaaaaugaugcuagaauuagauccaccauuuggggacagcuauauaguaauaggaguaggugaaaagaaaaucacacaucauuggcauaggaguggaagcacaauaggaaaagccuuugaagcaacaguaagaggagcaaaacgaauggccgugcuaggugauacagcaugggauuucggaucaguggguggagcucucaauuccuuaggaaaagggauacaucaaauauuuggagcugcauuuaaaagucuauuuggggguaugucuugguuuagucaaauauuaauuggaacauuacuuauguggcugggauuaaacacuaaaaaugguucgauaaguuuaauguguuuagcauuaggugggguuuuaauuuuucuaaguacagcaguauccgccgauguggguuguaguguagauuuuucaaaa

SEQ ID NO: 2614 - RNA, 2136 nt, Artificial Sequence
  KU681081.3 prME-long CDS opt
agaauaauaaaugcaagaaaagaaaagaaaagaagagguacagacaccaguguaggaauaguaggauuacuauugacaacagcaauggcugcagaaguuacacgcagaggaucugcuuacuauauguaccuagauagaagugaugcaggagaagccauuucauucccaacaacuuuagguaugaauaaauguuauauacaaauaauggaucuaggacacaugugcgacgcaacuaugaguuaugaaugcccuaugcuagaugaaggaguagaacccgaugauguugauuguugguguaacacaacaaguacauggguaguauacggaacaugucaucauaagaaaggcgaagcaagaagaagcagacgagcaguuacauuaccgagccauucaacaagaaaacuacaaacaagaucucaaaccugguuagaaagucgagaauauacaaaacauuuaauuagaguagaaaacuggauauucagaaauccaggauuugcuuuagcagcugcagcuauagcauggcuacuaggaucauccacaucacaaaaaguuauauacuuaguaaugauucuauuaauagccccagcauauucaauaagaugcauagguguaaguaauagagauuucgucgaaggaaugaguggaggaacauggguugacguaguacuagaacauggaggcuguguaacaguaauggcccaagauaaaccgacuguagauauagaauuaguaacaacaacaguaaguaauauggccgaagucagaucauacuguuaugaagccagcauaagugauauggcaagcgauuccagauguccaacucaaggugaggcauauuuagauaaacaaucggauacacaauaugugugcaaaagaacucuaguagacagaggauggggaaacggcuguggauuauuuggaaaaggaagucuaguaacaugugccaaauuugcaugcucaaagaaaaugacuggaaaaucaauacaaccagaaaaucuagaauaucgaauaauguuaagugugcauggaagucaacacagcggaaugauaguaaacgauacuggucaugagacagacgaaaacagagcaaaaguagaaauaacaccuaauucaccacgagcagaagcaaccuuaggaggcuucggaucccuaggauuagauugugaaccacgaacaggcuuagacuuuagugauuuauauuauuuaacaaugaauaacaaacauuggcugguacauaaagaaugguuucacgauaucccauuaccauggcacacaggugcagauacaggaacaccacauuggaacaacaaagaggcgcuuguagaauuuaaagaugcucacgcaaaaagacaaacaguuguaguauugggaucucaagaaggcgcaguacauacagcauuagcuggagcucuagaagcagaaauggacggugcaaaaggccgacugucuucuggucacuuaaaaugcagacucaaaauggauaaauuaagacuuaaaggcguaucauacaguuuauguaccgcugcuuucacauuuacaaaaauaccagcugaaacuuuacauggaaccguaacaguagaagugcaauacgcugguacugauggaccauguaaagugcccgcucaaauggcaguagauaugcagacacuaacaccagugggacgauuaauuacugcaaauccaguuauuacagaaggaacagaaaacucaaaaaugauguuagaauuagauccaccauuuggugauucauauauaguaauaggaguaggugagaaaaagauuacacaucauuggcauagaucaggaucaacaauagggaaagcguucgaagcuacaguaagaggagcuaaaagaauggcaguauuaggagacacggcaugggauuuuggaucaguggguggaguacucaauucauugggaaaaggaauacaccaaauauucggagcagccuucaaaagccuauuuggaggaaugaguugguuuagucaaauacucauaggaacauuguuaauguggcuaggcuuaaauacuaaaaauggcaguauaucacuaaugugucuugcacugggaggaguacuuauauuucuaucaacagcuguauccgcagauguaggauguagcguagauuuuagcaaa

SEQ ID NO: 2615 - RNA, 2136 nt, Artificial Sequence
  KU744693.1 prME-long CDS opt
agaauuauaaaugcaaggaaagaaaaaaaaagaaggggagcugauacaucaguaggaauaguuggucuucuacuaacuacagcaauggcagcggaaguaacgcgaagaggaucagcauauuauauguaucuagauagaaaugaugcaggagaggcaaucucuuuuccuacaacauuaggaaugaacaaauguuacauacaaauaauggacuugggacauaugugcgaugcaaccaugucauaugaauguccuauguuggaugaagguguagaaccugaugacguugauuguuggugcaauacaacaucaacauggguaguauacgggacaugucaucacaaaaaaggugaagcuagaagaucaagaagagcuguuacauuaccuucacacucaacacgaaaauuacaaacaagaucacaaacaugguuagaaucaagagaauauacaaaacaccuaauaagaguagaaaauuggauauuuagaaauccagguuuugcauuagcagcagcagcaauagcaugguuauuaggauccucaacgagucaaaaaguuauuuauuuaguaaugauuuuguuaauugcuccagcuuauucaauaagaugcauagguguaaguaaucgagacuuuguagaagggaugaguggugggacauggguagauguaguauuagaacacggcggaugcguaacggcaauggcgcaagacaaaccaacaguagauauagaacuaguuacaacuacgguuucuaacauggcagaaguaagaucuuauugcuacgaagcaucaauaucagacauggcaucugauaguagauguccaacacaaggggaagcauaucuagauaaacaaucagauacacaauauguauguaaacgaacucuaguagaccguggcugggguaacggaugcgggcucuuuggaaaaggaucauuaguaacaugugcaaaauuugcuuguuccaagaaaaugacaggaaaaagcauacaaccagaaaaccuugaauauaggauaauguuaucaguacauggcucacaacauagugguaugcuuguaaaugauacaggacaugaaacggacgaaaaccgagcaaaaguugaaauaacuccaaauaguccgcgagcugaagcaacguuaggcggauuuggaagcuuagggcuagauugugaaccaagaacaggauuggauuucucagaucuuuauuauuuaacaaugaauaauaaacauugguuagcacacaaggaaugguuccaugauauaccccuaccauggcaugcaggugcagccacgggaacuccucauuggaacaauaaagaagcauuaguagaauuuaaagacgcacacgccaaaagacaaaccgucguuguacuuggaucacaagagggagcaguacauacagcauuagcaggagcauuggaagcagaaauggauggugcuaaaggaagauuaucuagcggacaucuaaaaugcaggcuaaaaauggacaaacuacgauuaaaagguguaagcuauagucuaugcacagcagcuuuuacauuuacaaaaauacccgcagagacuguugacgguacaguaacaguagaaggucaauauggagggacugaugguccuugcaaaguuccagcacaaauggcagucgacaugcaaacacuaacgccaguugguagacuaauaacagcgaaucccgucauuacagaaucaacagaaaauucuaaaaugauguuagaauuagauccaccauuuggcgauagcuauauaguuaucggaguaggcgaaaaaaaaauaacucaucauuggcaccggaguggaagcacuauaggaaaagcauucgaagccacaguaaggggugcaaaaagaauggcagugcuaggagauacugcaugggauuuuggaaguguagggggcgcauuaaauaguuuaggaaaaggaauacaucaaauaauaggugcagccuuuaaaagucuauucggaggaaugaguugguuuagccaaauauuaauaggaaccuuacugaugugguuaggacuuaacacgaaaaauggaagcauaucacuuaugugucucgccuugggaggaguauuaauauuucuaucgacggcaguaagcggcgggguagguuguucaguagauuuuucaaaa

SEQ ID NO: 2616 - RNA, 2136 nt, Artificial Sequence
  KY328290.1 prME-long CDS opt
agaauaauaaacgcaagaaaagaaaaaaaaaggagagguacagauacauccgucggaauaguggguuuauuacuuacaacugcaauggcggcagaaguaacacgaagaggaagcgcauauuauauguauuuagaucgaagugaugcgggagaagcaauaagcuucccaacaacauuaggaaugaacaaauguuauauacaaauaauggauuuaggacacaugugugaugcaacgaugucauaugaauguccaauguuagaugaaggaguagaaccggaugaugucgauuguugguguaauacaacaucaacauggguaguauauggaaccugccaucauaaaaaaggugaagcaagaagaucuaggagagcaguaacgcuuccaagucauaguacaaggaaauuacaaacuagaagucaaacaugguuagaaaguagagaauacacuaaacauuuaauacgaguagaaaacuggauauuuagaaauccaggcuucgcauuagccgcagcugccauagcaugguuauuagguucgaguacgucacaaaaaguuauauauuuaguuaugauucuauuaauugcccccgcauauaguauaagaugcauaggagugaguaaccgggauuuuguugaaggaaugucaggaggaacaugggucgauguuguauuagaacaugguggaugcguaacaguuauggcacaagacaaaccaacaguggacauagaauuaguaacaacaacgguaaguaauauggcagaaguacgaaguuacuguuaugaagcaaguauaucagauauggcaagcgauucuagauguccaacucaaggcgaagcauaucuagauaaacaauccgauacacaauacgugugcaagaggacguugguagauagaggaugggguaaugggugcggguuauucggaaaagguucauuaguaaccugcgcuaaauucgcguguucuaaaaaaaugacaggaaaaucaauacaaccggaaaauuuagaguauagaauaauguugucaguucauggaagucaacauucaggaaugauaguaaaugauacuggacaugaaacagacgagaaccgagcaaaaguugaaauaacaccaaauaguccaagggcagaagcuacauuaggaggauuuggcucucuaggacuggauugugaaccaagaacuggcuuagauuuuagcgaccuauauuaccuaacgaugaauaauaagcacuggcuaguacacaaagaaugguuccacgauauaccauuaccauggcaugcaggugcagauacaggaacuccacauuggaauaauaaagaagcacuaguggaguuuaaagacgcacaugcaaaaaggcaaacaguuguaguuuuaggcagucaagaaggcgcuguacauacagcauuagcaggagcacuagaagcggaaauggauggagcaaaaggaagauuaucaagcggacaucuaaaauguagguuaaaaauggauaagcuuagauuaaaaggagucaguuacucauuauguacggcagcuuuuaccuuuagcaaaauaccagcagaaacacuacacggcacaguuacugaagaagugcaauaugcuggaacugauggcccaugcaaaguaccggcacaaauggcaguagauaugcaaacacuaacaccaguaggaagauuaauaacagcaaacccaguaauaacagaaucaacagaaaacaguaaaaugauguuagaauuagacccaccauuuggagauucauauauagucauaggaguaggagaaaaaaaaauuacccaucauuggcauagaagugguaguacaauaggcaaagcauucgaagcuacaguaagaggagcaaaaaggauggcagucuuaggagacacagcaugggauuuuggaucaguaggaggagcuuuaaauaguuuaggaaaaggaauucaucagauauucggagcagcauuuaaaagccuauucgguggaaugagcugguuuucgcaaauauugauaggaacauuacuaaugugguuaggauuaaacacaaaaaacggaucuauaagucugaugugccuagcguuagggggcguucuaauauuccucucaacagcaguaucagcggacguaggauguucaguagauuucucaaaa

SEQ ID NO: 2617 - RNA, 2136 nt, Artificial Sequence
  KX694532.2 prME-long CDS opt
agaauaauaaaugcacgaaaagaaaaaaaaagaagaggaacagacacuucaguaggcauuguaggacuacuacuuacaacagcaauggcagcagagguaacacgaaggggaagugcauauuauauguauuuagacagaucagaugcaggagaagcgaucucauuuccuacaacauugggaaugaauaaauguuacauccaaauaauggaucugggccauaugugugaugcaacaaugaguuacgaauguccaauguuagaugaaggggucgagccagaugauguagauuguugguguaauaccacuucaacauggguuguuuauggaacaugccaucauaaaaaaggagaagcaagaagauccagaagggcaguaacauuaccaucacauucuacacgaaaauuacaaacccgaucgcaaacauggcuagaaaguagagaauacaccaaacauuuaauaagagucgaaaauuggauauucagaaacccaggcuuugcuuuagcagcagcugcgauagccuggcuacuaggaaguagcacuucacaaaaagucaucuauuuaguaaugauuuuacuaaucgcuccagcauacagcauuagauguauuggaguuaguaauagagacuuuguagaaggaaugucaggcggaacauggguugaugugguccuagaacauggcggauguguaacaguaauggcccaagauaaacccacaguagauauagaauuaguaacgacaacagugagcaauauggcagaaguaagaucauauugcuacgaagcuucaauaucugauauggcaagcgauucgagaugcccaacacaaggagaagcauaucucgauaaacaaagcgacacucaauauguaugcaaaagaacacuaguagacagaggcugggguaaugguugugguuuguuuggaaaagggaguuuaguaacaugugcuaaauucgcaugcucgaagaaaaugacaggcaaaucaauacaaccugaaaauuuagaauacagaauaaugcuaaguguacaugguucacaacauucagguaugauuguaaaugauacaggucacgaaacagaugaaaauagagcuaaaguagaaauaacccccaauucaccaagagcugaagccacacuaggaggcuucgguaguuuaggguuagauugugaaccuagaacagggcuugauuuuucagaccuuuauuaucucacaaugaauaauaaacacuggcucguacauaaagaaugguuccaugacauaccucuacccuggcacgcuggagcagauacaggaacgccacacuggaauaauaaagaagcuuuaguagaauucaaagaugcccacgccaaaagacaaacuguaguaguacuaggaagucaagaaggagcaguacacacagcuuuagcaggagcauuagaagcggaaauggacggagcgaaaggaagauuaucaucuggucauuuaaaauguagauugaaaauggauaaacuaagauuaaaagguguuucauauagcuuaugcacagcugcauuuacauuuacaaaaauaccagcagaaacuuuacauggcacaguaacaguagaaguccaguaugcagguacugauggaccuuguaagguacccgcacaaauggcaguagauaugcaaacacucacaccaguaggaagacuaauuacagcuaauccaguuauuacagaaagcacagaaaauuccaaaaugaugcuagaguuagauccaccuuuuggugacaguuauauagugauaggggucggagaaaaaaaaauaacacaucacuggcauagaagcggaucaacaauaggaaaagcauuugaagccacaguaagaggagcuaaaagaauggcuguacuaggcgauacagcaugggauuucggaaguguuggcggagcucugaacagccucgggaaagguauacaucaaauauuuggugcggcauuuaaaaguuuauuuggaggaaugucaugguuuucacaaauauuaauaggaacacuacuaaugugguuaggucucaauacuaaaaauggaaguauaagcuuaauguguuuagcauugggaggagucuuaauauuccuaucaacagcaguaagugcagauguaggauguaguguugauuuuuccaaa

SEQ ID NO: 2618 - RNA, 2136 nt, Artificial Sequence
  KU955593.1 prME-long CDS opt
agaaucauuaaugcacguaaagaaaagaaaagaaggggaacagauacgucuguaggaauaguuggacuacuauuaacaacugcaauggcuguagaaguaacaagaagaggaaaugccuauuauauguauuuagauaggucggacgcaggagaagcaauuucauucccaacaacaaugggaaugaacaaauguuauauccaaaucauggaccuuggacauaugugugacgcaacaaugucauaugaauguccaauguuagaugaagggguugaaccagaugauguagauuguuggugcaacacaacaagcacauggguagucuacggaacaugucaucauaagaaaggagaagcacgaagaucaagacgagcaguuacauuaccaagucacucaacaagaaaauuacaaacaagaucacaaacauggcucgaaaguagagaauacaccaaacaucugauccgaguagaaaacuggauauuuagaaaucccgguuuugcucuugcugccgccgcaaucgcaugguuacuaggaucgucuacuucacaaaaaguuauauauuuaguaaugauauuauugauagcuccagcauauuccauuagaugcauaggaguuuccaauagagauuuuguagaagggaugagcggagguaccuggguagauguaguauuagaacacggaggaugcguuacaguaauggcacaagacaaaccaacaguagacauagaauuaguuacaacaacaguaucaaacauggcagaaguucguuccuauugcuacgaagcaaguauuucagauauggcaagugauaguagauguccgacacaaggagaagcauauuuagacaaacaaucagacacucaauauguauguaaaagaacucuaguagauagagguuggggaaauggcuguggauuauucggcaaaggaucucuaguaacaugugcaaaauuugccuguaguaagaaaaugacaggaaaauccauccaaccagaaaauuuagaauaucgaauaauguuaucaguacauggaucacaacauuccggaaugaucgucaacgauacuggucaugagacugaugaaaauagagcaaaaguagaaauaacaccaaauucaccucgagcugaagcaacauugggaggauuuggaucacuaggacuagacugugaaccaagaacaggacuugauuuuagcgacuuauauuaccuuacgaugaacaauaaacauugguuaguacauaaagaaugguuucacgacauaccacuaccuuggcaugcaggagcagauacgggaacuccccauuggaacaauaaagaggcuuuaguagaguucaaagacgcacacgcaaaaagacaaacaguaguaguucuuggaagucaagaaggagcuguacacacagccuuagcuggugcacuagaagcagaaauggauggagcaaaaggaagauuaaguaguggacacuuaaaauguagauuaaaaauggauaaauuacgauuaaaaggaguuucauauucauuaugcacagcagcuuuuacguucacgaagauaccagcagaaacacugcacggaacaguaacaguagaaguacaauaugccgguacagauggaccuuguaagguaccagcacaaauggcuguugacaugcaaacauuaacucccguugguagacuaauaacagcaaauccaguaauaacugaaagcacagaaaauucuaaaaugaugcuagaauuagauccaccuuuuggagauagcuacaucguaauaggaguuggcgaaaagaaaauaacucaucacuggcaccguucagggucaaccauugguaaagcauuugaagcaacaguaagaggagccaaaagaauggcgguacuaggagauacggcaugggauuuuggaaguguaggaggugcccuaaauuccuuggguaaaggaauacaccaaaucuuuggagccgcauuuaaaucauuauucgggggaaugaguugguucagccaaauauuaauuggaacacuauuaguaugguuaggauugaauacuaaaaauggaucuauaucacuaaugugccuagcauuaggaggagugcucauauuccuaaguacugcuguuucagcagauguaggauguaguguagauuucagcaaa

SEQ ID NO: 2619 - RNA, 2136 nt, Artificial Sequence
  KY272987.1 prME-long CDS opt
agaauaauaaaugcaagaaaagaaaaaaaacgaagaggaacagauacaagcguggguauaguuggcuugcuauugacuacugcaauggcagcugaaguaaccagaagaggaagugcauacuacauguaucuagaucguucugaugccggugaagcaaucucauuuccuacaacauuagguaugaacaaauguuauauacaaauaauggaucuaggucauaugugugaugcaacaaugucuuaugaauguccuaugcuggacgagggaguugaaccagaugacgucgauugcuggugcaauaccacguccacauggguaguuuauggaacuugucaccacaaaaaaggagaagcaagaagaaguagaagagcaguaacgcuaccaagucauaguacaagaaaacuccaaacaaggucacagacuuggcucgaaaguagggaauauacuaaacaucuaauacgaguagaaaauuggauauuuagaaauccaggguuugcguuagcagcagcagcaauagcuugguuauuaggcuccaguacuucacaaaaaguaaucuacuuaguaaugauauuauuaauagccccagcauauucaauaagauguauagguguuaguaauagagauuuuguagaaggaaugucaggagguacuuggguagaugucguucuagaacacggaggaugcguaacaguaauggcacaagauaaacccacuguagauauagaacuaguuacaacaacuguauccaauauggcagaaguaagaaguuauuguuacgaagcuagcauaagcgauauggcaagugacucaagaugucccacacaaggugaagcauaccuugauaaacaaucagauacucaauauguaugcaaacguacacugguagaccguggaugggggaauggaugcggacuauucgguaaaggauccuuaguuacaugugcaaaauuugcuuguucaaaaaaaaugacugggaaaucaauacaaccagaaaacuuagaauauagaauuauguuaucgguacacggaucacagcauucuggaaugauaguaaaugauacaggacaugaaacagaugaaaaucgagcuaaaguagaaauaacuccuaauaguccaagagcggaagcaacucuaggagguuuuggaagucuaggauuagauugcgaaccgagaacuggguuagacuuuucagauuuauauuaucuaacuaugaacaacaagcacugguuaguacauaaagagugguuucaugauauaccgcuaccauggcaugcgggagcugauacaggaacuccacauuggaauaauaaagaagcacuaguggaauuuaaagaugcacaugcaaaacgacaaaccgugguaguacuaggaucacaagaaggagcaguacauacagccuuagcuggugcauuagaagcagaaauggauggagcaaaaggaagauuaaguaguggucaucuaaaauguagacuaaagauggacaaauuaagauuaaagggagugucuuacagucuauguacagcagccuuuacauuuacaaaaauaccugcugaaacauuacacggaacaguaacuguggaaguacaauaugcagguaccgauggaccauguaaaguuccugcacaaauggcuguagauaugcaaacucucacaccgguaggacgacuaauaacagcaaauccaguaaucacagaaaguacugaaaauaguaaaaugaugcucgaguuagauccacccuuuggcgacagcuauauaguaaucggaguaggugaaaaaaaaauuacacaccacuggcacaggaguggaagcacaauaggaaaagcuuucgaagcaacaguuagaggugcaaaaagaauggcuguacugggagauacagcaugggacuuuggaaguguaggaggagcacuaaauagcuuaggaaaaggaauacaccaaauauuuggagcagcauuuaaaucacuauuuggagguaugaguugguuuucgcaaauuuuaauaggaacauuauuaaugugguuagggcuaaauacaaaaaauggaaguauaucauuaguuugucuagcgcucggaggaguacuuauauuuuuaagcacagcaguaucagcagacguuggauguaguguggauuuuagcaaa

SEQ ID NO: 2620 - RNA, 2136 nt, Artificial Sequence
  EU545988.1 prME-long CDS opt
agaauaauaaaugcaagaaaagaaaaaaaaagaagaggaacagacacaaguguuggaauuguugguuuacuacuuacgacagcuauggcaguagagguuacaaggagagguagugcauauuauauguaccuagauagaucagaugcaggagaagccauaucauuuccgaccacuuuaggaaugaauaaauguuauauacaaauaauggaucuaggacauaugugugaugcaacaaugaguuacgaaugcccaauguuagaugaaggaguagaaccugaugauguagauugcugguguaacacuaccucaacauggguuguauacggaacaugucaucauaaaaaaggugaagcuagacgaagcagacgagcuguaacguuaccaagucauucaacacgaaaacuacaaacuagaucacagacauggcuugaaucaagagaauauacaaaacacuuaauuagaguugaaaauuggauauuuagaaauccaggauuugcacucgcagcagcagcaauugcauggcuccuuggcaguaguacaucacaaaaaguaauauauuuaguuaugauauuauuaauagcuccagcauacaguauucgaugcauaggaguuucaaacagagacuuuguagaaggaaugucaggaggcacauggguagacguaguacuagaacacggcggauguguuacaguuauggcccaagauaaaccagccguagauauugaauuaguuacuacgacaguaaguaauauggcagaagugagaucauauuguuaugaagcaaguauaucagauauggcgucagauagccguugccccacccaaggcgaagcuuaucuagacaaacaaagugacacacaguacguauguaaaagaacauuaguagacaggggauggggaaauggaugcggacuauuuggcaaaggaagcuuaguaacaugcgcaaaauucgcuuguagcaaaaaaaugacaggaaaaucaauacaaccagaaaacuuagaauauagaauuauguugucaguacacgggagucaacauuccggaaugauaguaaaugacacuggucacgaaacagacgaaaauagagcaaaaguagaaauaacgccaaauucuccuagagcagaagcaacacuaggaggauuugggucuuuaggguuagacugugagccaagaacaggauuagauuuuucugauuuauauuauuuaacaaugaauaacaaacauugguuaguacauaaagagugguuccaugacauaccucuaccauggcaugcaggagcagauacuggaacuccacacuggaauaacaaagaagcacuuguugaauuuaaagacgcucaugcaaaaagacaaaccguaguuguauuaggaucacaagaaggugcggugcacacagcuuuagcaggggcccuagaagccgagauggauggugcaaaagguagacuuagcucuggucaccuuaaaugccgacuaaaaauggauaaauuaagacuaaagggaguaaguuauagccuauguaccgcagcguuuacauuuacaaaaauaccagcagaaacacuacauggaaccgugacaguagaaguucaauacgcaggaacagaugguccauguaaaguaccagcacaaauggcaguagauaugcaaacauuaacaccagugggaagauuaauaacagcaaacccaguaauaacagaaaguacagaaaauucaaaaaugauguuagaauuagaccccccuuuuggagauagcuauauagucauagguguuggcgaaaaaaaaauaacacaucauuggcauagaagcgguucaacaauaggaaaggcauuugaagcaacgguacgaggugcgaaaaggauggcuguauuaggagauacggcaugggauuuuggaucaguaggaggagcguuaaauucauuaggcaaaggaauacaucaaauauucggagcugcguuuaaaucauuauuuggugguaugucaugguucagucaaauauuaauaggaacacuuuuagucuggcuagguuuaaacaccaaaaaugguagcauaucauuaacaugcuuagcauuaggaggaguauuaauauuccucagcacagcgguuucagcagacguaggauguaguguagauuuuaguaaa

SEQ ID NO: 2621 - RNA, 2136 nt, Artificial Sequence
  KU681082.3 prME-long CDS opt
agaauaauaaaugccagaaaagaaaaaaaaagaagaggagcggacacuucaguagguauaguaggacuauuauuaacaacagcgauggccguagaaguaacaagaagaggaagugcauauuauauguacuuagauagaagcgacgcaggagaagcgaucaguuucccaacaacauuagguaugaauaaauguuauauacaaauaauggaucuuggacauaugugugacgcaacuaugucauacgaauguccaaugcuagacgaaggaguagaaccugaugacgucgauuguugguguaauacaacuagcacauggguaguauauggaacaugucaucauaaaaagggugaagcuagaagaaguagaagagcaguaacgcuuccaucacacaguacaagaaaauuacaaacuagaagucaaacauggcuagaaucuagagaauauacuaaacaucucauacgaguagaaaacuggauauuucguaauccgggauuugcauuggcugcggcuguaauagccugguuauuaggaaguaguacaagucaaaaagugauauauuuaguaaugauacuacuuauugcuccagcuuacaguauaagaugcaucggaguaucaaauagagauuucgucgaaggaaugaguggagggacauggguagacguaguacuagaacauggaggcugcguaaccguaauggcacaagauaaaccaacaguagauauagaauuaguaacaacgacaguuuccaauauggcugaaguacgaucauacuguuaugaagccagcauuagugacauggcaucugauucuaggugucccacucaaggugaggcauaucuagacaaacaaucagauacacaauauguauguaaaagaacauuaguagauagaggaugggggaauggaugugggcuauuuggaaaaggaucguuagucacaugcgcgaaauuugcuuguucaaaaaaaaugacaggcaaaucaauucaaccugagaauuuagaauauagaaucauguuaucaguucauggaucacaacacagcggaaugauaguaaaugauacgggacaugaaacugacgaaaauagagcaaaaguugaaauaacuccaaauuccccuagagcagaagcaacacuagguggauuuggaucauuaggacuagauugcgaaccaagaacaggauuagauuuuagcgaucuauacuauuuaacaaugaauaacaaacauugguuaguacauaaagaaugguuucaugauauaccauuaccauggcaugcaggggcagacacugguacaccgcauuggaauaauaaagaagccuuaguagaauuuaaagacgcacaugcaaaaagacaaacaguugucguauuagguucucaagaaggagcaguacauacggcuuuagcaggagcucucgaagcugagauggacggagcaaaaggcagacuuucaaguggacaucucaaauguagguuaaagauggauaaacuucgauuaaaaggaguaaguuacucccuauguacugcagcauuuacuuuuacaaaaauaccagcugaaacuuugcauggaacaguaacaguagaaguacaauacgcaggaacggacggaccaugcaaaguuccagcacaaauggcaguagauaugcaaacacugacgccaguaggaagguuaauuacagcgaacccaguaauuacagaaucuaccgaaaauucaaaaaugauguuagaauuagaccccccuuuuggagacucuuacauaguuaucggaguaggugaaaaaaaaauaacacaccauuggcaucguagugguuccacaauaggaaaagcuuucgaagcaacuguaaggggagcaaaaagaauggcaguuuuaggagacacggcaugggacuucggaaguguaggaggggcacugaauucucuaggaaaaggcauacaucaaauauuuggugccgcauuuaaaucauuauuuggaggcaugaguugguuuucucaaauauuaauugguacauuauuaguauggcuaggauugaauaccaaaaacggauccauaucacuaacaugucuagcacuuggaggaguucuaaucuuucuaucaacagcuguaucagcagauguaggcuguucuguagauuuuagcaaa

SEQ ID NO: 2622 - RNA, 2136 nt, Artificial Sequence
  KX601167.1 prME-long CDS opt
agaauuauuaaugcaagaaaagagaaaaaaagaagaggagcagauacaaguguuggaauaguaggauuacuacuaacaacagcaauggcaguggaaguaacacgcagaggaucugcauauuauauguaucuagauagaagugaugcuggagaagcaauaaguuuuccgacaacucuaggaguaaacaaauguuauauucaaauaauggaucuaggacacaugugcgaugcaacuaugucauacgaguguccuauguuagaugaaggugucgaaccugaugauguagacuguugguguaauacaacauccacguggguagucuauggcacaugucaucauaaaaaaggagaagcuagacgaucaagaagagcaguuacucuaccaagccacucgacaagaaaacuacaaacaagaucacaaacauggcuugaaucaagagaauauacaaaacaucuaauaagagucgaaaauuggauauucagaaauccaggauuugcauuagcagccgcagcaauagcaugguuauuaggcucaaguacaagccaaaaaguaauauaucuaguaaugauacucuuaauagcaccagcauacucuauaagaugcauugguguuaguaacagagacuuugucgaaggaaugucgggaggaacuuggguagauguaguacuagaacaugguggauguguaacaguaauggcacaagauaaaccaacaguagauauagaauuaguuacaacaacgguaucaaauauggcagaaguuagaagcuacuguuaugaagcaaguauuucagacauggcaucagacucaagauguccuacacaaggagaagcauaucuugauaaacaaagcgauacacaguacguauguaaaagaacacuaguugauagaggaugggguaauggauguggucuauuuggaaaaggaaguuuaguaacuugugcaaaauuugcauguucuaaaaaaaugacaggaaaaucaauucaaccugaaaacuuagaauauagaauaauguuaucuguacauggaucccaacauucaggaaugauuguaaaugauacaggucaugaaacagaugaaaauagagcuaaaguagaaaucacuccgaacucaccacgagcagaagcuacuuuaggaggauucgggucauuaggccuugauugcgaaccaaggaccggacuagauuuuucagauuuauacuacuuaacuaugaauaauaaacacugguuaguacacaaggaaugguuucaugacauacccuuaccauggcaugcaggagccgacacaggaacuccacauuggaauaauaaagaagcacuaguagaauucaaagaugcucaugccaaaagacaaacaguaguaguuuuaggaagccaagaaggcgcuguccauacagccuuagcaggagcacucgaagcagaaauggauggagccaaaggaagacuaucaucaggucauuuaaaaugucgucuuaaaauggauaaauuaagacuuaaagguguuaguuauagcuuauguacagcggcauuuaccuuuacaaaaauaccugccgaaacacuucacggaacaguuacaguugaaguacaauaugcagggacagacggaccaugcaaaguuccugcacaaauggcaguugauaugcaaacauuaacaccaguaggcagauuaauaacagcaaacccaguuauaacugaaucaaccgaaaacaguaaaaugauguuagaauuagauccaccuuuuggcgacaguuauauaguaauaggaguaggugacaaaaaaauaacucaucacugguacagaaguggaucaacuauagggaaagcauuugaagcaacaguaagaggggcaaaaagaauggccguauugggagauacggcaugggacuuuggcucaguaggcggugcuuugaauaguuuaggaaaagguauacaucaaauauuuggagcagcauuuaaaucauuguuuggaggaaugaguugguuuucucaaauuuugauugguacauuauuagugugguuaggacuaaauaccaaaaacggaaguaucagccuaacuugcuuagcccuaggggggguacuaauauuuuuaaguacagcagugagugcggacguaggaugcagugucgacuuuucaaaa

SEQ ID NO: 2623 - RNA, 2136 nt, Artificial Sequence
  KX694533.2 prME-long CDS opt
aggauaaucaaugcaagaaaagaaaaaaaaagaagaggugcugacacauccgucggaauaguaggacuguuacuaaccaccgcgauggcuguagaaguaacacgacgcggcagcgcauauuauauguacuuagauagaagugaugcagguaaagcaaucuccuuuccaacaacauuaggaguaaauaaauguuacauacaaauaauggauuuaggacauaugugugaugcaacaaugucauaugaauguccuaugcuggaugaaggaguagaaccugaugacguugauuguuggugcaauaccacuucaacaugggucguauauggaacaugucaucauaaaaaaggagaagcuagaagaagcagaagagcgguuacucuuccaagucauaguacuagaaaacuacaaacaagaucucaaacuuggcuugaaucaagggaauacaccaaacauuuaauaagaguagaaaauuggaucuucagaaauccaggauucgcacuagcagcagcggcaauagcauggcuacuugguucaucuacaagccaaaaaguaauauauuuagucaugauacuauuaauagcacccgcauauucuaucagaugcauaggaguaaguaauagagauuuuguagagggaauguccggaggaacauggguagauguaguccucgaacaugguggauguguuacagugauggcacaagacaagccaacaguagauauagaauuaguuacgacaacugucucaaauauggcagaaguaagaagcuauuguuaugaagcaagcauaucugauauggcaagcgauucaagauguccuacucaaggagaagcguauuuagauaaacagucagacacacaguacguauguaaacgaacacuaguagacagaggauggggaaacggauguggauuauucggaaaagguaguuuaguaaccugugcaaaauuugcguguucaaaaaaaaugacuggaaaaaguauacaaccagaaaauuuagaauauaggauaaugcucagcgugcauggaucacaacauucaggaaugauaguaaacgauauaggacaugaaacagacgaaaaucgagcaaaagucgagauaacacccaauucaccacgagcagaggcuacccuuggagguuucggaucauuaggauuggauugcgaaccacgaacaggacucgauuuuagugauuuauauuaucuuacaaugaacaacaaacauugguuaguacauaaagaaugguuucaugacauuccacuaccauggcaugcaggagcagauacugguacaccacacuggaacaauaaagaagcacuaguagaauuuaaagaugcucacgcuaaaagacaaacaguagugguauuaggaagucaagaaggagcaguacauacagcacuagcaggagcccuggaagccgaaauggauggagcaaaaggaaggcuaucaucaggccaucuaaaaugcagacuaaaaauggauaaauugagauuaaaaggaguaucguauagcuuaugcacagcagcguuuacuuuuacaaaaauaccagcugaaacacuacacggaaccguaacuguagagguacaauacgcaggaacagaugguccauguaaagucccagcacaaauggcaguagauaugcaaacauuaacacccguaggaaggcuuauaacugcaaauccaguuauaacagaaaguacagaaaauucuaaaaugaugcuggaauuagauccacccuucggagauucauacauaguaauaggaguaggagauaaaaaaauuacacaucauuggcauagaucugggaguacaauugguaaagccuuugaagcaacagugcgaggcgcaaaaagaauggcaguauuaggagauacagcuugggauuuuggaucagugggaggagcauuaaauaguuuaggaaaaggaauacaucaaauauucggagcagcauuuaaaagucuauuuggaggcaugucaugguuuucacaaauucuuauaggaacgcuuuuaguaugguuaggauuaaauacaaaaaauggaucaauaucacugacauguuuagcgcuagguggcguuuuaauauuuuuaagcacggcaguaucagcagacguaggaugcucaguagauuuuuccaaa

SEQ ID NO: 2624 - RNA, 2136 nt, Artificial Sequence
  KY288905.1 prME-long CDS opt
agaauaauaaaugcaagaaaagaaagaaaaagaagaggagcagauacaagcauagguauaguagggcuauuauuaacaacugcuauggcagcagaaaucacgagaagaggaagugcauauuacauguauuuggacagaucugaugcaggaaaagcaauaucuuucgcaacaacuuuaggcguaaacaaaugucauguucaaauaauggacuuaggccacaugugugaugcgacaaugaguuaugaauguccaauguuagaugaaggaguagagccagaugauguugauuguuggugcaauacaacaagcacaugggucguuuacgggacuugucaucauaagaaaggagaagcaagaagaaguagacgagcuguuacuuuaccaagccauaguacaagaaaauugcagacaagaagccaaacauggcucgaaagcagagaauauacaaaacauuuaauaaaaguagaaaauuggauauuccgaaacccaggauuuacgcugguagcaguagccauagcuugguuguuaggauccuccacgucacaaaaagugauauacuuagugaugauauuacuaauugcaccagcuuauucaauaagguguauaggaguaucaaauagagauuuuguagaaggaaugaguggaggaacuuggguagacguaguacuagaacauggagguugugugacuguaauggcacaagauaaaccgacuguugauauagaacuuguaacaacaacuguaucaaauauggcugaaguaagaucauacugcuaugaagcaucuauaagugauauggccuccgauucaaggugcccaacacaaggggaggcuuacuuagauaaacaaagugauacacaauauguauguaaacgaacauuaguagauagaggaugggguaaugguugcggauuauuuggaaaaggaaguuugguaacaugugcuaaauuuacuugcaguaagaaaaugacaggcaaaagcauacaaccggaaaaucuggaauauagaauaauguuaucaguacauggaucacaacauaguggaaugauaguaaaugacacugggcaugaaacagaugaaaauagagcaaaaguagaaguuacaccgaacagcccaagagcggaagcaacuuuagguggguucggaucccuaggacuagacugugaaccaagaacaggcuuggauuuuagugacuuauauuaccuaacaaugaacaauaaacauuggcuaguucauaaagaaugguuucacgauauaccauuaccauggcacgcaggagcagauacaggaacaccacauuggaauaauaaagaagcgcuagucgaguucaaagaugcacacgcaaaacgacaaacaguagucguacuugguucacaagaaggagcaguucacacugcuuuagcgggugcauuagaagcagaaauggauggagcaaaaggaagacuauuuucaggacaucuuaaaugccgucuuaaaauggauaaauuaagacuuaaaggaguaaguuauucacuaugcacagcagcauucacauuuacuaaaguuccugcagaaacauuacacggaacagugacaguugaaguccaauacgcuggaacagaugguccauguaaggucccagcacaaauggcgguagauaugcaaacauugacaccaguuggaagacuaauuacagcaaauccaguaauaacagaaaguacagaaaauaguaaaaugauguuagaauuggacccacccuuuggagauaguuauauaguuauaggaguaggagauaagaaaauaacacaucacuggcauagaucuggaucaacgauaggaaaagcauuugaagcaacuguaagaggagcuaaaagaauggcaguacuuggagauacagcaugggacuucggcucaguaggcggugucuucaauucauuaggaaaaggaauacaucaaauauuuggcgcagcauuuaaaucacuauucggagguaugaguugguuuucacaaauacuuauaggaacccuuuuaguuuggcuaggacuaaauacuaaaaaugguucaaucaguuuaacauguuuggcauuaggaggaguuaugaucuuucuaagcacagcuguuagugcugauguaggguguagcguagauuuuucaaaa

SEQ ID NO: 2625 - RNA, 2136 nt, Artificial Sequence
  KF268950.1 prME-long CDS opt
agaauuauaaaugcaagaaaagagagaaagagacgaggagccgacacaucuauaggaauaauaggacuacuauuaacaaccgcaauggcagcagaaauaacucgaagagggagugcauacuacauguauuuagaucgaucagacgcugguaaagccauaaguuuugcgacuaauuuaggaguaaacaaaugccauguucaaauuauggaccuaggacauaugugcgaugcaacaaugaguuacgaauguccaaugcuagaugaaggaguagaaccagacgauguagauugcugguguaauacaacaucaacauggguuguauacggaacaugucaucauaaaaaaggagaagcaagacgaucaagaagagcaguaacuuugcccucucacagcacaagaaaauuacagacccgaagccaaaccuggcuagaaucaagagaauauacaaaacaucuuauaaaaguugaaaauuggauauuuagaaaucccgguuuugcguuagcagcaguagcuauagccugguuacuuggaagcaguacaucacaaaaaguuauauauuuaguuaugauauuauuaauugcgccagcuuauucaauuagauguaucggaguaagcaaccgggauuucguugagggaaugucaggggguacauggguagauguaguauuagaacaugggggaugcguaacaguaauggcgcaagauaaaccaacaguagacauagaauuaguaacaacgaccgugucaaacauggcagaaguucgcucauauuguuaugaagcaaguauaucugauauggcaucagacucaagauguccuacacaaggugaagcauacuuagacaaacaaucugauacucaguacgucuguaaacgaacucuaguagacagaggauggggaaauggaugcggucuauuugguaaaggaucacuagugacuugugcaaaauuuacauguagcaaaaaaaugacagguaaaaguauucagcccgaaaaccuugaguauagaauaauguuaucaguccauggaucucaacauagugguaugauagucaaugauauaggccaugaaacagaugaaaauagagcaaaaguugaaguaacaccaaauucaccaagagcagaagcaacccuagggggauuuggaucacuuggauuagauugugaaccuagaacuggacuagacuuuucagacuuauacuauuuaacaaugaacaauaaacauugguugguacauaaagaaugguuucacgauaucccuuuacccuggcaugccggagccgauacaggaaccccacauuggaauaauaaagaggcacuaguugaauuuaaggaugcacaugcgaaaagacaaacaguaguaguacuaggaucacaagagggagccguacauacggccuuagcuggagcacuagaagcagaaauggacggagcuaaaggaagacuauuuagcgggcacuugaaaugccgauuaaaaauggauaaauuacgacuuaaaggaguuuccuacucauuaugcacagcugcauuuacguuuacuaaaguaccugcagaaacauugcacggaacaguaacaguagaaguacaauaugcugguacagauggacccuguaaagugccagcgcaaauggcuguggauaugcaaacauuaacuccuguuggaagacuaauaacagcaaauccaguaauaacagaaucaacugaaaacaguaaaaugauguuagaauuagacccuccauuuggggauucguauauaguaauagguguuggagauaaaaaaauaacacaucauuggcauagaagugggucgacaauaggaaaagcuuucgaagcaacaguaagaggagcaaaaagaauggcagucuuaggagacacagcaugggauuuuggaucaguuggaggugucuucaauaguuuagguaaaggaguacaccaaaucuucggagcagcuuucaaaagucuauuugggggaaugucaugguuuucacaaauacuuauuggaacauuacuagucugguuaggacucaauacaaaaaauggcaguauaagcuuaacauguuuggcauuaggaggcgugaugauuuuccuaagcacagcaguaucagcagacguagguuguaguguugauuucaguaaa

SEQ ID NO: 2626 - RNA, 2136 nt, Artificial Sequence
  KF383121.1 prME-long CDS opt
cgaauaauaaacgcaagaaaagaacgaaaaagaagaggagcagacacaucaauuggaauaauaggucuguuauuaacaacagccauggccgcagaaauuacaagaagaggcagugcauauuauauguauuuagaccgaagugaugcuggaaaagcaauaucauucgcuacuacauugggagucaauaaaugucauguccaaauuauggaccuuggucauaugugcgacgcaacuaugucauaugaauguccgauguuagaugaggguguugaaccagacgacguagauuguuggugcaacacaacaaguacuuggguaguauauggaacaugccaucauaaaaaaggagaggcacgccgaaguagaagagcaguaacacuaccaucucacucaacaagaaaauuacaaacuaggucacaaacaugguuagagucacgcgaauacacaaaacauuuaauaaaaguagaaaauuggauauuuagaaauccaggauuugcacuuguagccguagccauagcuuggcuacuugguagcucaacaagucaaaaaguaauauauuuaguaaugauauuacuaauagccccagcauacaguauaaggugcauagguguaucaaauagagauuuuguagaagguaugucaggcggaacauggguagauguaguacuugaacacggaggaugcguaacaguaauggcgcaagacaaacccacaguagacauugaacuaguaacaaccacaguaagcaauauggcugaaguaagaucuuauuguuacgaagcaaguauaagcgauauggcaagugauucaagauguccuacacaaggcgaagcauauuuggauaagcaaagugacacucaauauguuuguaaaagaacuuuagucgacagaggauggggaaauggaugcggacuuuuuggaaaaggaagccuaguaacaugcgccaaauucacauguaguaaaaaaaugacaggaaaaaguauacaaccugaaaaccuagaguacagaauaaugcuuaguguacacggaagccaacacuccggaaugauuguaaaugauauuggucaugaaacagacgaaaauagagcaaaaguagaaguuaccccaaacucaccuagagcagaggcaacacuagguggauuuggcucauuaggauuagauugugaacccagaacagggcuagacuuuagugacuuauauuaucuaacgaugaacaauaaacauugguuaguccauaaagagugguuccaugauauaccccuaccauggcaugcgggagcagauacugguacaccacauuggaacaacaaagaagcauuaguagaauuuaaagacgcucaugcuaaaagacaaacuguaguaguauuaggaucacaagaaggugcagugcacacagcauuagcaggugcucuagaagcagaaauggauggagcaaaaggaagauuauucucagggcaucuaaaaugccgauuaaaaauggauaaauuaagauuaaaagggguaaguuauucauuauguacagcagcauucacuuuuacuaaaguaccagcagaaacauuacacgguacagucacaguagaaguacaauaugcaggaacagauggaccaugcaaaguaccagcacagauggcaguagauaugcaaacauuaacaccaguuggacguuuaauaacagcgaauccaguaauaacagaaucaacagaaaauaguaaaaugaugcuagaguuggauccgccauuuggggauucuuacauaguuauaggagugggugacaaaaaaauaacucaccauuggcacagaagcgguucaacaauaggaaaagcauuugaagcaacaguaagaggagccaaacgaauggcaguacucggagauacagcaugggauuuuggaucagucggagguguauuuaacucauuaggaaaagguauacaucagauauucggggccgcuuuuaaaucauuauuuggcggaaugucaugguucagucaaauauuaauuggcacuuuauugguuuggcuaggacuuaauacaaaaaaugggaguauaagccuuaccuguuuagcguuaggaggaguuaugauauuuuugucaaccgcaguaagugcggauguaggaugcaguguagacuucucaaaa

SEQ ID NO: 2627 - RNA, 2118 nt, Artificial Sequence
  KF268949.1 prME-long CDS opt
aggauuauaaacgcaaggaaagagagaaaaagacguggagccgauacaagcaucggaauaauaggccuauuacuaacaacagccauggcagcugagauuacaagaagaggaagcgcauauuacauguauuuagauagaagugaugcuggaaaagcaauaucauuugcaacaaauuuaggaguaaauaaaugucauguccaaauaauggacuuagggcacaugugcgaugcaacaaugagcuaugaauguccaauguuagaugaaggagucgaaccagaugacguagauuguugguguaauacaacaucaacauggguaguauacgguacuugccaucauaagaaaggagaagcgagaagaucaagacgagccgugacucucccgagucacaguacacguaaauuacaaacucgaucacaaacaugguuagaaucucgagaauauacaaaacauuuaaucaaaguagaaaacuggauauucagaaauccaggauucgcacuagccgcaguagcaauagcaugguuauuagggaguaguacuucucaaaaaguaaucuaucucguaaugauccuauuaauugcaccagcauauagcauacguugcauaggaguaagcaacagggauuuuguggaagguaugaguggaggaacauggguagauguaguauuagaacacggagguugcguaacuguaauggcccaagacaaaccaacaguagauauagaacucguaacaacaacaguaucaaauauggcagaaguaagaaguuauuguuaugaagccaguauuucagauauggcaucagacuccagaugcccgacacaaggggaagccuauuuagacaagcaaagugauacacaauauguauguaaacgaacauuaguugauaggggaugggguaauggauguggauuauucggaaaaggaucauuaguaacaugugcaaaauucacuuguuccaagaaaaugaccggaaaaucaauacaacccgaaaacuuagaauacagaauaaugcuaucuguacauggaucacaacacaguggaaugauaguaaaugacgaaaauagggcaaaaguagaagucacaccaaacagcccucgagcggaagcaacauuaggaggauuuggaagucuaggauuagacugugaaccaaggacuggucuagauuuuucggaccuauauuauuuaaccaugaauaacaaacauugguuaguacauaaagaaugguuucaugauauuccauuaccguggcaugcuggugcagauacaggaacaccgcauuggaacaauaaagaagcauuaguagaauuuaaagaugcacaugcaaaaagacaaacaguaguaguuuugggcagccaagaaggugcaguucauacugcacuggcuggagcucucgaagcagaaauggauggagccaaaggaaggcuauuuucaggacacuugaaauguaggcuaaaaauggauaaacuaagauuaaaaggcguaucauauucucuauguacagcggccuuuaccuuuacaaaaguuccagcagaaacucuacauggcacaguuaccguagaaguacaauaugcaggcacagauggaccaugcaaaguaccagcacaaauggcaguagacaugcaaacauuaacacccguagggagauuaauaacagcaaauccaguuauaacugaaucaacugaaaacagcaaaaugauguuggaacuagauccaccuuucggcgauaguuacauaguaauagguguaggagauaagaaaauaacacaucacuggcaucguaguggaagcacaauaggaaaagcauuugaagcaacaguaagaggggcuaaaagaauggcaguacuaggagauacagcuugggacuucggaucaguaggggguguauuuaauagcuuaggaaaaggcauacaccaaauauuuggagcagcauuuaaaaguuuauuugggggaaugaguugguucucacaaauauuaauaggaacuuuauugguuugguuaggucucaacacuaaaaacgguaguauaucauuaacaugucuagcacuaggaggaguaaugaucuuuuuaucaacagcaguaucagcagacguagguuguaguguagauuuuucaaaa

SEQ ID NO: 2628 - RNA, 2136 nt, Artificial Sequence
  KU955595.1 prME-long CDS opt
cgaauaauuaaugcaagaaaagaaagaaaacguaggggagcagacacaucaauuggcauugucggauuauuauuaacaacugcuauggcagcagaaaucacaagaagagguagugcuuauuauauguauuuagauaggagugaugcaggaaaagcaauaucauuugcaaccacacuaggcguaaauaaaugucaugugcagauaauggauuuaggacauaugugcgaugcuacuaugaguuaugaauguccaauguuagaugaaggaguagaacccgaugauguagacuguugguguaacacaacgaguacaugggugguauauggaacaugucaucauaagaaaggagaagcaagaaggaguagaagggccguuacacuaccuagucauaguacaagaaaauuacaaacaagaagccaaacaugguuggaaagccgcgaauacacaaaacauuuaauaaaaguagaaaauuggauuuucagaaauccgggcuuugcccuaguagcaguagcaauugcaugguuacuaggaaguuccacaagucaaaaaguaauuuauuuaguaaugauauuacuaauagcgccagcauacucuauaagguguauuggaguaaguaauagagauuuuguagaaggcaugaguggaggaacuuggguagauguaguacuagaacauggaggaugugucacagugauggcccaagacaaacccacaguagauauagagcuaguaacaacuaccguaaguaacauggcggaaguaagaucauacuguuaugaagcaaguauaucagacauggcuuccgauaguagauguccgacacaaggagaagcguaccuggauaaacaaagcgacacacaauauguauguaaaagaaccuuaguagauagaggauggggaaaugguugugguuuauuuggaaaggguagcuuaguaacaugugcaaaauuuacauguucaaagaaaaugacgggaaaaucaauacaaccugaaaacuuggaauauagaauaaugcuaaguguacauggaucacaacauaguggaaugauaguaaaugauacaggacaugaaacggaugaaaaucgagcaaaaguggaaguaacgccaaacucaccaagagcggaagcgacauuaggagguuucggaucauuaggguuggacugugaaccacgaacaggacuagauuucagugauuuauacuauuuaacuaugaauaacaaacauugguuaguucauaaagaaugguuucaugauauaccauuaccauggcacgcaggcgcagauacgggaacaccacauuggaacaauaaagaagccuuagucgaauuuaaagaugcacacgcgaaacgccaaacuguaguaguuuuaggaucacaagaaggagcaguacauacagcauuagcuggugcauuggaagcggaaauggauggagcaaaaggaagauuauuuagcggucauuuaaaaugucgacuaaaaauggauaaauuaagauuaaagggaguaucauauucacuauguacagcagcauuuacuuuuaccaaaguuccagcugaaacauuacauggaacgguaacuguagaaguacaauaugcaggaacugauggaccuuguaaaguaccugcucagauggcaguugauaugcaaacauuaacaccuguaggacgauugauaaccgcaaauccagugauaacagaaucuacagaaaauaguaaaaugauguuggaauuagauccaccuuuuggugacaguuauauuguaauaggaguaggugauaagaaaauuacacaccacuggcacaggagugguaguacuauaggaaaagccuuugaagcuacaguaagaggagcaaaaagaauggcuguguuaggagauacagcuugggacuuugguucaguuggcggaguuuuuaauucguuagggaaaggcauucaucaaauauucggugcagcauucaaaagccuauucggaggaaugagcugguucagucaaauacuuauaggaacacuauuaguguggcuugguuuaaauacgaaaaauggaucaauaaguuuaacauguuuagcauuaggugguguaaugauauucuuaaguacagcaguaagcgcagauguaggauguucuguagacuucucaaaa

SEQ ID NO: 2629 - RNA, 2136 nt, Artificial Sequence
  KF383116.1 prME-long CDS opt
agaauaauaaaugcaagaaaagagcgaaaaagaagaggagcagacacaucuauugggauaguaggacuauuauuaacaacagcgauggcggcugaaauuacaagaagaggaagugcuuacuauauguacuuagaccgaagugaugcuggcaaagcaauaucguucgcuacaacacuugggguaaacaaaugccacguucaaauaauggacuuaggacauaugugugaugcuacgaugagcuacgaauguccaauguuagaugaagguguagaaccagaugacguagacuguugguguaacacaacaaguacauggguaguuuauggaacaugucaacacaagaaaggggaagcaagacguagcagacgagcagugacacuaccuagucauaguacuagaaaacuacaaacaagaucacagaccugguuagaaaguagagaauauacaaaacaucuaauaaaaguagaaaauuggauauuuagaaaucccggauuugcccuaguugcaguagcaauagcaugguuauuaggaucaagcacaagucaaaaaguaauauauuuaguaaugauauuacuuauagcaccagcuuacagcauuagauguauagguguaucaaauagagacuuuguggaggguaugagcggaggaacauggguugauguaguauuagaacauggaggcuguguuacuguaauggcucaagacaaacccacaguagauauagaauuaguaacgacaacaguaucgaauauggcagaagucagaucuuauuguuacgaagcgagcauaucagacauggcaagugauaguagaugucccacucaaggugaagcauauuuagacaaacaaucagauacacaauauguauguaaaaggacauuaguagaccgggguuggggaaauggaugcggacuauuugguaaaggcagcuuaguuacaugugccaaauuuacauguucuaagaaaaugacaggaaaaaguauacaaccagaaaauuuagaauauagaauuauguuaaguguacauggaagccaacauucaggaaugaucguaaaugacauuggacaugagacugaugaaaauagagcaaaaguagagguaaccccaaauucuccuagggcagaagcaacacucggaggauucggaaguuuaggacuagauugugaaccaagaacaggacuagauuuuucagauuuauacuaucuaacaaugaauaauaaacauuggcuagugcauaaagaaugguuucacgacauuccgcuaccauggcaugcaggagcagauaccggaacaccacauuggaauaacaaagaagcucugguagaauuuaaagaugcacaugcaaaaaggcaaacgguaguaguucuuggaucacaagaaggagcaguacacacggcauuagcaggagcauuagaggcugaaauggauggugcuaaaggucggcuauuuucaggucauuuaaaaugcagguuaaaaauggauaaauugagauuaaaaggaguaagcuauagucuauguacagcuguuugcacagcugcaaaaguaccagcagaaacauuacauggaacuguaacaguagaaguacaauacgcaggaacagauggaccuuguaaaguaccagcacaaauggcuguagauaugcaaacacuuaccccaguaggacgauuaauuacagcaaaccccguaauaacagagucaacggaaaauaguaaaaugauguuagaauuagacccucccuuuggugauucauacauaguaauaggaguaggagauaagaaaauaacacaccauuggcacagaucaggcucaacaaucggaaaagccuucgaagcuacaguacgaggagcaaaaagaauggcaguauuaggagauacugcaugggauuuuggcaguguaggaggaguauuuaauaguuuagguaaagguauucaucaaauuuuuggagcagcuuucaaaucauuauucggaggaaugaguugguuuucacaaauacuuauaggaacacuauuaguaugguuaggacuuaauacgaaaaacgggucaaucagcuuaacauguuuagcacuagguggcguaaugauauuucuuucaacagccguuagugcagauguaggcuguuccguugauuucagcaaa

SEQ ID NO: 2630 - RNA, 2118 nt, Artificial Sequence
  KU963574.2 prME-long CDS opt
agaauaauaaacgcuagaaaagaacggaagagaagaggagcugaugcgucaauaggaauaguaaguuuauuauuaacaacaguaauggcugcagaaauuacaaggagaggaucagcuuauuauauguauuuagacagaagugaugcgggaaaagcaauaaguuuuguaacaacauuaggaguaaauaaaugucauguccaaauaauggacuuggggcauaugugcgaugcaacaaugucuuaugagugcccaauguuggaugaaggaguugaaccagaugauguagauuguugguguaauacaacaucaacuuggguaguauacggaacaugccaccacaagaaaggggaagcuagaagaucaagaagggcaguaacauugccaagucauaguacgagaaaacuacaaacacguagccagacauggcuugaaucaagagaauauacaaaacacuugauaaaaguagagaauuggauuuuccgaaauccagguuucgccuuaguugcaguagcaauugcaugguuacuaggaagcagcacuucucaaaaaguaauauauuuaguaaugauauuacuaauagcaccagcauauucaauaagauguauaggagugaguaacagagauuucguagaagguaugaguggaggaacauggguagacguaguacucgaacacgguggaugcguaacaguaauggcucaagacaaaccaacaguagauauugaacucguaacaacaacaguaucaaauauggccgaaguuaggucuuauugcuaugaggcaucaauaucagacauggcaucagauagcagauguccuacacaaggagaagcauauuuagauaaacaaucagacacacaauacguaugcaaaagaacauuaguagauagaggcuggggaaacggcuguggacuguuugggaaaggaucucucguaacaugcgcuaaauucaccuguaguaagaaaaugacaggaaaaaguauacaaccagaaaaccuagaauauagaauuauguuaagcgugcauggaagccaacacagcgggaugauaguuaaugaugaaaauagggcaaaaguagaggucacgccaaacagcccaagagcagaagcaacauuaggagguuucggaagccucggauuagauugugaaccaaggacuggauuagauuucucagauuuauauuaucuuacaaugaauaacaaacacuggcuaguacauaaagaaugguuucacgauauuccauuaccauggcauucaggagcagacacugaaacaccacacuggaauaauaaagaagcguugguagaauuuaaagaugcacacgcaaaaagacaaaccguaguagucuuagguucgcaagaaggagcaguacauacagcacuagcaggcgcgcuagaagcugaaauggauggugcaaaaggaagacugucaucaggucaucuaaaauguagauuaaaaauggauaaauuaagacuaaaagguguaucauauuccuuauguaccgcagcguuuacuuucacaaaaguuccagccgaaacauuacauggaacaguaacuguagaaguacaauaugcagggcgagacggaccuuguaaaguuccagcacaaauggcaguugauaugcaaacauuaacaccaguugggagauuaauaaccgcaaacccaguaauaacugaaucaaccgaaaauucaaagaugauguuagaauuagaucccccauuuggagacuccuauauagugauaggaguuggagauaagaagauaacccaucauuggcauagaucaggaagcauuauaggaaaagcauuugaagcaacaguaagaggcgcaaaaagaauggcaguacuaggcgauacggcaugggacuuuggaucagugggaggaguuuucaacagucuaggaaaagguauucaccaaauauucggagccgcauucaaaagccuauucggagguaugucaugguuuucacagauucuaauaggaacgcuucuaguaugguugggauuaaauacuaaaaauggaaguauaucacuaacaugucuugcuuuaggaggaguaaugauauucuugucaacagcaguuucugcagacguuggaugcaguguggauuuuaguaaa

SEQ ID NO: 2631 - RNA, 2118 nt, Artificial Sequence
  KX601166.1 prME-long CDS opt
agaauaauaaaugcaagaaaagaaagaaaaagaagaggagcugauacaucuauuggaauaguaggcuuguuauuaacaacagcuauggcagcagaaauaacaagaagaggaagcgcuuacuauauguauuuagacaggagugaugccggaaaagcaauaucauuugcaacaacauuaggggucaauaaaugucauguccaaauaauggacuuaggacauaugugcgacgcaacaaugaguuaugaguguccaauguuggacgaaggaguagaaccagaugauguagauuguugguguaauacgacuuccacauggguaguuuacggaacuugucaucauaagaaaggagaagcuagaagaagcaggagagcaguaacacuaccaucacauaguacuagaaaacuucaaacaagaagccaaacauggcuagagucaagagaauauacaaaacacuugauaaaaguagaaaauuggauauuuagaaauccaggcuuugcauuaguggcaguagcuauagccuggcuuuuaggaagcaguacaagucaaaaaguaauauauuuaguaaugauauuauuaauagcaccagcauauucaaucagaugcaucggagugaguaauagagacuucguagaagguaugagcggaggaacauggguagaugugguacuagaacacggaggcuguguaacaguaauggcacaagauaagccgaccguagauauugaauuaguaaccaccaccgugaguaauauggcagaaguuagaucauauugcuaugaagcaaguaucagugauauggcaagcgauaguagauguccgacacaaggagaagcauaccuagauaaacaaagcgacacacaauacguauguaaaagaacacucguagauagaggauggggaaacggauguggauuauuugggaaaggaucccuaguaacaugugccaaauuuacuuguucgaagaaaaugacuggaaaaaguauacaaccugaaaacuuagaauauagaauaaugcuaucaguacaugguagccaacauagcggaaugauaguaaaugaugaaaacagggcaaaaguagaaguaacgccuaauagcccaagagcagaagcuacacuagguggauuuggaaguuuaggacuagauugcgaaccacgaacgggguuagauuuuagugacuuauauuauuuaacuaugaacaauaaacauugguuaguacacaaagaaugguuucacgacauaccauuacccuggcaugcaggagcggauacaggaacaccacauuggaauaacaaagaagcucuaguggaauuuaaagaugcacaugcaaaaaggcaaacaguuguaguacugggaucacaagaaggagcgguucauacagcccuagcaggagcacuagaagccgaaauggauggagcgaaaggaagauuauucucaggacauuuaaaaugucgauuaaaaauggacaaacuacgauuaaaaggaguuaguuacucauuauguacagcagccuucacguuuacaaaaguaccagcagaaacacuacacggaacaguaacuguagaaguacaauacgcuggaacagauggaccuuguaaaguaccugcccaaauggcgguagauaugcaaacauuaacaccuguggguagguuaauaacagcaaauccaguaauaacugaaucaacagaaaacaguaaaaugauguuagaauuagauccacccuuuggugauagcuauauagucauaggaguaggugacaagaaaaucacacaucauuggcaccgaaguggcucaacgauagguaaagcauucgaagcaacaguucgaggagcuaaaagaauggcaguacuaggagauacagccugggauuuugggaguguagguggaguauucaauagccuagggaaaggaauacaccaaauauucggggcagcauucaaaagucuauuuggugguaugaguugguuuucacaaauauuaauaggcacuuuauuaguauggcuaggguuaaauacuaaaaacggaagcauuagcuuaacaugccuagcgcugggagguguaaugauauuucuaaguacagcaguaagugcagauguaggauguagcguugauuuuucaaag

SEQ ID NO: 2632 - RNA, 2136 nt, Artificial Sequence
  KF383118.1 prME-long CDS opt
agaauuauaaaugcaagaaaagaaagaaaaagaaggggagcugacacuucaauaggaauaauaggauuacuacuuaccacagcaauggcagcagaaauaacacgaagaggaucugcauauuacauguaucucgauagaagcgacgcagguaaagccauaaguuuugcaaccacauuagguguaaauaagugucauguacaaaucauggacuuaggacauaugugugacgcaaccaugagcuaugaaugcccuaugcuagacgaaggaguagaacccgaugacgucgacuguuggugcaacacuacaagcacaugggucguuuaugguaccugucaucauaagaaaggagaaacucgaagaucaagaagaaguguaucucuuagauaucauuacacaagaaaacuacagacaagaucucaaacauggcuagaaucaagagaauauaagaaacaucuaauaaugguugaaaauuggauauucaggaacccaggauuugcaauaguuaguguugcaauaacauggcuuaugggaaguuuaacaagccaaaaaguuauauacuuaguaaugauaguucuaauuguaccagcuuauucaauaagcugcauaggagugaguaacagagauuuagucgaaggaaugucagguggaacauggguagauguaguauuagaacaugggggaugcguuacagaaauggcccaagauaaaccgacaguagauaucgaauuaguaacaaugaccguaucaaacauggccgaaguaagaucauauuguuaugaagcaucacuaucagauauggcaagugcaagcagaugcccaacucaaggggaaccaucucuagauaaacaaucagacacacaaucaguaugcaaaagaacauugggugauagaggauggggcaacggcuguggcauuuuuggaaaaggaagucuaguuaccuguaguaaauucacgugcuguaagaaaaugccaggaaaaaguauucaaccagaaaaccuugaauacagaauuauguuaccaguacauggaucgcaacauaguggcaugauagugaaugauauaggucacgaaacagacgaaaauagagcaaaaguugaagugacaccaaacaguccaagagcagaagcaacauuaggaggauuuggaucauuaggauuagauugugaaccacgaaccgggcuagauuucagcgaucuuuauuacuuaacgaugaauaauaaacacuggcuaguacauaaagaaugguuccaugacauaccauuaccauggcacgcaggagcagauacuggaacuccacauuggaauaauaaagaagcacuuguugaguucaaagaugcacaugcaaaaaggcaaacaguaguaguacuaggaagccaagaaggagcuguucacacagcguuagcaggcgcacuugaagcugaaauggauggagcaaaaggaagauuguuuucaggacauuuaaagugcagacuuaaaauggacaaacuaagacuaaaaggcgucucuuacucauuauguacagcagcauuuacauucacuaaagugccagcagaaacacuacauggaacugucacaguagaaguccaaucugcagguacagauggcccauguaaaguacccgcccaaauggcaguugacaugcaaacgcugacaccaguagguagacuaauaacagcaaacccuguaaucacagaaucaacagaaaacuccaaaaugauguuagaacuagauccaccuuucggagauaguuauauuguaauuggaguaggagauaagaaaauaacacaucauuggcauagaagcggaaguacuauaggaaaagccuucgaagcuacaguaagaggcgcuaaaaggauggcugucuuaggugauacagcuugggauuuuggaucaguaggggguguauucaauagucuaggaaaaggaauacaucaaauuuuuggagccgcguucaaaaguuuauucggagguaugucgugguuuucacaaaucuuaauaggaacauuacugguauggcuaggacuaaauacuaaaaauggcaguauuagcuuaacauguuuagcuuuaggaggaguaaugauauuucuuagcacagcaguuagugcggaugucggauguucuguagacuuuucuaaa

SEQ ID NO: 2633 - RNA, 2130 nt, Artificial Sequence
  KF383120.1 prME-long CDS opt
agaauuauuaacgcucguaaagaaagaaaaagacguggugcagacacaagcauagggauaauagguuugcuauuaacaacugcaauggcugcugaaauaacaagacgaggaucagcauauuauauguaccuggauaggucugaugcaggaaaagcaauaucauucgcaacuacaaugggaguaaauaaaugucauguacaaauaauggauuuaggacacaugugugaugcuacaaugaguuaugaauguccuauguuagacgaaggaguagaaccugaugauguugacuguugguguaauacuacuagcacauggguuguauaugggaccugccaucauaagaaaggagaagcaaggccaucaagacgagcagucacauuaccgagucauaguacucgaaaauuacaaacucgaagucaaacgugguuagaaucacgugaauacacaaaacacuuaauaaaaguagaaaauuggauacuucgaaacccuggguuuacgguagcagccuuagcaauggcauggcuucuaggaaauaguacaagucaaaggguaauauaccuaguaaugauuuuauuaauagcacccgcauauucaauaagaugcauaggaguaagcaauagagauuuuguagaagguaugucaggaggaacauggguagauguuguacuagaacacggcggaugcguaacaguuauggcucaagacaaaccaacaguagauauagaauuaguaacuacaacaguaucaaauauggcugaaguaaggaguuauuguuaugaggcaaguaucucagauauggcaagugacaguaggugcccaacccaaggcgaggcuuaucuagauaaacaaagugauacucaauacguauguaaaaggacgcuaguagauagaggauggggaaacgguuguggacuauuuggaaaaggaagccuaguaacaugugccaaauuuacauguucaaagaaaaugacaggaaaaaguauacaacccgaaaaucuagaauauagaauuaugcuaaguguacauggaucucaacacucaggaaugauaguaaaugacauaggacaugaaacagaugaaaauagagcaaaaguggaaguuacaccaaauaguccaagagcagaagcuacacuggguggauucgggagcuuaggguuagauugugaaccaaggacaggauuagauuucucagaucuauacuaucuaacaaugaacaacaaacauugguuaguucauaaagaaugguuucacgacauaccacuaccauggcacgcaggagcagauacaggaacaccacauuggaacaauaaagaagcauuaguagaguucaaagacgcacaugcuaaaagacagacaguaguuguucuaggaagccaagaaggagcuguacauacagcacuugcaggagcacuugaagcagaaauggauggugcaaaagggagacuuuucagcggacacuuaaaaugccgaauaaaaauggauaaauuaagauuaaaaggugucucguauucuuuauguacagcagcauuuacauuuaguaaaguaccagcagaaacauuacaugguacgguaacagucgaaguacaauaugcaggaagagauggaccauguaaaguaccagcacagauggcaguagauaugcaaacauuaacaccuguagggagauuaauaacggccaauccuauaauaacagaaaguacagaaaauucacgcaugaugcuugaacucgauccaccauucggagauaguuauauagugauaggaguaggugauaagaaaauaacccaucauuggcauagaaguggaaguacuauagguaaagcauucgaagcaacagugagaggagcuaaacgaauggcaguauuaggcgauacagcuugggauuuugguaguguagguggaguauucaauagucuaggaaaaggaguacaccaaguauucggagcggcauuuaagagcuuguucggaggaaugagcugguucucacaaauacuuauagguacauuauuaguauggcuaggauuaaauacuaaaaacggaaguauuucauuagcaugucuugcucuagguggugcaaugauuuuucuaagcacugccguuucugcagacguugguuguagcguagauuuc

SEQ ID NO: 2634 - RNA, 2061 nt, Artificial Sequence
  KU321639.1 prME-short CDS opt
acuagcguaggaauaguaggauuauuauuaacgacagcaauggcugcagaaguaacucgacgcggaucagcauauuauauguaccucgacagaaaugacgcaggagaagcaauuaguuucccuacaacauuagggaugaauaaauguuauauccaaaucauggauuuaggacacaugugugaugcaacaaugagcuacgaauguccaauguuagacgaagguguagaaccagacgacguagacuguuggugcaauacaacaucaacauggguaguauaugguacaugccaucauaagaaaggcgaagcuagaagaaguagacgagcaguaacacuaccaucacauagcacaagaaaauuacaaacaagaucucaaaccuggcuagaaucaagagaauauacuaaacauuugauaagaguagaaaauuggauauuuagaaauccaggauucgcuuuagcagcagcugccauugccuggcuuuuaggaucaucaacaagccaaaaaguaauauauuuaguaaugauauugcuuauagcgccagcauacagcauaagauguauaggaguuucaaauagagauuuugucgaaggaaugagcggaggaacauggguagauauaguacuugaacauggaggaugcgugacaguuauggcccaagacaaaccuaccguagacauagaauuaguuacaacuacuguaucuaauauggccgaaguaagaaguuauugcuacgaggcuucaauuagugacauggcaucagauucuagaugcccaacucaaggugaagcauaccuagacaaacaaagugacacgcaauacgucuguaaaagaacauuaguagacagaggauggggcaauggaugcggauuauucggaaaaggcagcuuaguaacuugugcaaaauucgcauguagcaagaaaaugacaggaaaaucaauacaaccagaaaacuuagaauacagaaucauguugucaguucauggcagccaacauucaggaaugauaguaaacgauacuggacaugaaaccgaugaaaauagagcaaaaguagaaauaacuccaaauaguccuagagccgaagccacauuaggugguuuuggaucauuaggacuagauugugaaccacgaacaggacuagauuuuagugauuuauauuaucuaacgaugaauaauaaacauugguuaguacauaaagaaugguuucaugauauaccacuuccauggcaugcaggagccgauacuggaaccccacacuggaauaauaaagaagcauuaguugaguucaaagaugcccacgcaaagagacaaacaguaguaguauuaggaucacaagaaggggcaguacauaccgccuuagcuggagccuuagaagcagaaauggacggagcuaaaggaagacugaguagcggacacuugaaaugucgacugaaaauggauaaguuaagguuaaaaggaguaaguuauaguuuauguacagcugcauuuacauuuaccaaaauaccagccgaaacccugcaugggacgguuacaguagaaguacaauaugcaggaacggauggaccauguaaaguaccagcgcagauggcaguugauaugcaaacacuaacaccaguaggaagacuuauaaccgcaaauccggugauaacagaaaguacagaaaacuccaaaaugauguuagaauuagauccaccauuuggagacucauauauagugauaggagugggagaaaagaaaauaacacaccauuggcauagaaguggaaguacaauaggaaaagcguucgaagcaaccguaagaggagcaaaaagaauggcaguucuaggagauacugcaugggauuucgguagcguaggaggagcauuaaauucacuaggaaaaggaauccaucaaauauuuggagcagcauucaaaaguuuauucggaggaaugaguugguuuucccaaauacuaauaggaacacuauuaaugugguuaggauugaauacgaaaaauggaucuauaucgcugaugugucuagcauuaggaggagucuuaauuuucuuaucaacagcaguaucagcg

SEQ ID NO: 2635 - RNA, 2061 nt, Artificial Sequence
  KU312312.1 prME-short CDS opt
acaucaguuggaauagucggacuucuuuugacaacagcaauggcugcugaaguuacgcgaagaggaagugccuauuacauguauuuggacagaaaugaugcaggagaggcuauuucauucccaacaacauuagggaugaacaaauguuauauacaaauaauggaucuuggucauacaugcgacgcgacgaugucauacgaauguccaaugcuugaugaaggaguagaaccugacgauguagacuguuggugcaacacaacaucaacuuggguaguauauggaacuugucaucacaaaaaaggggaggcaaggagaucacguagagcaguuacacuaccuucacauaguacaagaaaacuacaaacaagaucacaaacauggcucgaaucacgagaauauacaaaacauuuaauaaggguagaaaauuggauuuucagaaacccaggauuugcccuugcagcagcagcaauugcauggcuuuuaggaaguagcacaagucagaaagugauauacuuagugaugauuuuacuuauagcuccagcauauucuauaagaugcauaggaguaaguaauagagacuucguagaaggaaugaguggggguacuuggguagauguuguacuugaacacggcggaugcguaacaguaauggcccaagauaaaccaacuguagauauagaauuaguaacgacaacaguuucaaauauggcagaaguaagaucauauugcuacgaagcauccauaucagacauggcuucugauucuagauguccaacucaaggugaagccuauuuagauaaacaaucagauacucaauauguauguaaaagaaccuuaguagacagagguuggggaaauggaugcggauuauuuggaaaaggaagucuaguaacgugugcaaaauuugcaugcaguaaaaaaaugacuggaaaaaguauucaaccagaaaaccuugaauauagaauaauguugaguguacaugguagccaacauucaggaaugauaguaaaugauacaggccacgaaacagacgaaaauagagcaaaaguugaaauaacaccaaauagucccagagccgaagcaaccuuaggaggauucggaucucuaggauuagacugcgaaccuagaacaggacuagacuuuucagaucuuuacuauuuaacaaugaauaauaaacauuggcuagugcauaaggaaugguuucacgauauaccauuaccauggcaugcaggagcugauacagguacaccacauuggaauaauaaagaagcacuuguagaauucaaagacgcacacgcuaaacgacaaacaguaguaguauuagguagucaagaaggagcaguucauacagcauuagcuggggcauuagaagcagaaauggauggagcaaagggaaggcuaucaucaggacauuuaaaaugcagauuaaaaauggauaaauugagacucaaagguguaucauauucucuauguacagcagcuuucacuuuuacaaaaauaccagcagaaacucuucaugggacuguuacaguugaaguacaauaugcaggaacagaugguccaugcaaaguaccagcacaaauggcaguagauaugcaaacauuaacaccaguaggaagacugauaacagcaaacccaguaauaacagaaagcacagaaaauucaaaaaugauguuagaauuagauccuccauucggagauucauauauagucauaggaguaggagaaaaaaaaauaacacaucauuggcauagaucaggaucaacuauaggcaaagcauuugaagcaacaguaagaggcgcaaaaagaauggccguacuaggagacacagcuugggacuucggaagcguaggaggagcacuaaauaguuuaggaaaaggaauucaccaaauauuuggagcagcauuuaaaaguuuauucggaggaaugagcugguucucacaaauauuaauagguacuuuacuaaugugguuaggacuaaaugccaaaaacggaucaauaagcuuaaugugcuuagcucuuggaggugugcuaauauuccuuucaacagcaguaagugcu

SEQ ID NO: 2636 - RNA, 2049 nt, Artificial Sequence
  AY632535.2 prME-short CDS opt
acaucaauuggaauaauuggucuuuuacuuacuacagcaauggcagcagaaauaacaagaagaggaucagcauauuauauguauuuagaccguagcgaugccggaaaagcaauaucauucgcuacaacauuaggaguuaauaaaugucauguucaaauaauggacuuaggacauaugugugaugcaacuaugucuuaugaauguccaaugcuagacgaaggaguagaaccagaugauguagauugcugguguaauacuacuagcacauggguuguauaugguacaugucaucauaagaaaggcgaagcuagaagaaguagacgagcaguaacuuuaccaucucauucgacaagaaaauugcagacgagaucacaaacaugguuagaaaguagagaauauacuaaacauuuaauuaaaguagaaaacuggauauuuagaaauccggguuuugcauuaguggcagucgcuauugcaugguuauuaggcucaucaacgagucaaaaaguaauauaucuaguaaugauacuauugauagccccagccuauucaauaagaugcauaggaguaaguaauagagauuuuguagaagguaugagcggaggcacuuggguagaugucguuuuagaacacggaggaugcguaacaguaauggcucaagacaaaccaaccguagauauagaguuaguuacaacaacaguaaguaauauggcagaaguucgaucuuacuguuaugaagcaucaauaucagauauggcuagcgacucuagaugccccacacagggagaagccuacuuagauaaacaaagugauacccaauacguauguaaaagaacccuaguagauagaggauggggcaaugggugcggacuauuugguaaaggaucucuagugacaugcgcaaaauucacaugcucaaagaaaaugacaggaaaaaguauccaaccagaaaauuuagaauauagaauaauguuaucuguacauggcucacaacauucagguaugauaggauaugaaacugaugaagacagagcaaaaguagaagucacaccaaacuccccaagagcagaagcaacacuuggcggguuuggaaguuuaggauuagacugugaaccuagaacaggauuagacuucagugauuuauauuaccuaacgaugaacaauaaacacugguuaguacauaaagaaugguuucacgacauaccauuaccguggcaugcaggagcagauacuggaacaccucauuggaacaauaaagaagcauuggucgaguucaaagaugcucaugcaaaaagacaaaccguaguaguauuaggaucacaagaaggagcuguacauacagcauuagcaggagcgcuagaagcagaaauggauggagcaaaaggaaggcuauucucaggccaucuaaaauguaggcuuaaaauggauaaacuacgacugaaaggaguaaguuacucauuauguacagcagccuucaccuucacgaaaguaccagccgaaacucuacacggaacaguaacuguagaaguacaauaugcagguacagauggacccuguaaaauaccaguacaaauggcaguagauaugcaaacauuaacaccaguaggaagauuaauuacugcaaauccaguaauaacagaaaguacagaaaauucaaaaaugaugcuugaacuugaucccccauuuggagauucauauauaguaauaggaguaggagauaagaaaauaacacaucauuggcauagaucaggaucgacaauuggaaaagcauucgaagcaacaguaagaggagcgaaaagaauggcuguauuaggagacacagcgugggauuuuggaucagugggaggugucuuuaauagcuuaggaaagggaauacaccaaauauucggugccgcguuuaaaucacucuuuggaggcaugucaugguucagucaaauacuaauaggaacucuguuaguguggcuaggauuaaauacgaaaaauggaagcauuagcuuaacauguuuagcauuaggaggagugaugauauuccuaaguacagcaguaucagca

SEQ ID NO: 2637 - RNA, 2061 nt, Artificial Sequence
  KU527068.1 prME-short CDS opt
acaucaguaggaauuguuggauuauuacuaacaacagcuauggcagcugaggucacaagaagaggaucugcauauuauauguauuuagauaggaaugaugcaggagaagcuauaaguuucccgacaacccuagguaugaauaaauguuauauucaaauaauggaucuaggacacaugugugaugcuacaaugucauacgaaugcccuauguuagaugaaggcguagaaccagacgauguagauugcugguguaauacaacgagcacauggguaguauauggaacuugccaucauaagaaaggagaagcuagaagaaguaggagagcuguaacauuaccuagucauaguacaagaaaauuacaaacaagaucgcaaacaugguuggaaucaagagaauauacgaaacauuuaauaagaguagaaaauuggauauuuagaaauccaggguucgcuuuagcagcggcugcuauugcaugguuauuagggaguagcacuucacaaaaaguaauauauuuagugaugauauuauuaauagcuccagcauauucaauaagaugcauaggagugucaaauagagauuucguagaaggaaugucggguggaacauggguagauguaguuuuggaacauggcgguugcguaacaguaauggcucaagacaaaccuacaguagauauagaauuaguaacaacaacaguaaguaauauggcagaaguuagaucuuauugcuaugaagcaucaauuucagauauggcaagugacucacgaugccccacacaaggggaagcauaccuagacaaacaaucagauacucaauacguauguaaaagaacauuaguagaccgggguuggggaaacggaugcggucuauucggaaaaggaagucuaguaacaugugcuaaauuugcauguaguaagaaaaugacagggaaaaguauucagccugaaaacuuagaauauagaauaaugcugucuguacauggaagucaacauagugguaugauaguaaaugauacaggacaugaaacagacgaaaauagggcaaaaguggagaucacgccaaacaguccuagagcagaagcuacacuaggagguuuuggaagucuagggcuagauugugaacccagaacuggauuagauuuuucggauuuauacuacuuaacaaugaacaacaaacacugguugguccauaaagaaugguuucaugauauaccauuaccauggcaugcgggcgcagauacaggaacaccacauuggaauaacaaagaagcauuagucgaauuuaaagaugcccaugcaaaaagacaaaccgugguagucuuaggaagucaagaaggagcaguacauacagcacuagcuggcgcgcuugaagcagaaauggauggagcuaaaggaaggcuaucgucaggacauuuaaaauguagguugaaaauggauaaacuaaggcuaaaaggaguuaguuauagcuuguguacugcagcauucacguuuacaaaaauaccagcagaaacauuacacgguacaguuacaguugaaguacaauaugcagggaccgauggaccauguaaaguacccgcacaaauggcuguagauaugcagacacuaacacccguaggaagacuaauaacagcaaauccugucauaacagaaaguacagaaaacucaaaaaugaugcuugaauuagauccaccauuuggagauucuuacauaguaauaggaguaggagaaaagaaaauaacucaucacuggcaucgaaguggaaguacaauaggaaaagcauuugaagcaaccguuagaggagcaaaaagaauggcaguauuaggagacacagcuugggauuuuggaagcguaggaggagcauuaaacucauuagggaaagguauacaucaaauuuucggagcagcauuuaaaagucuauuugggggaaugucaugguuuagucaaauauuaauagguacauugcuaaugugguuaggacuaaauacuaaaaauggaaguauaaguuuaauguguuuagcacuuggaggaguacuaauauuuuuaagcacagcaguaagugca

SEQ ID NO: 2638 - RNA, 2061 nt, Artificial Sequence
  KX421193.1 prME-short CDS opt
accucaaucgguauuauaggacuacuauuaacaacagcaauggcggccgaaauaacgagaagaggaucagcauauuacauguaucuagaccgaagugaugcaggaaaagcaauaucuuuugcuacaacacuaggaguaaacaaaugucauguacaaauuauggacuuaggacauaugugugacgcgacaaugucauacgaaugucccauguuagaugaaggaguugaaccagaugauguagacuguugguguaacacaaccaguacuuggguaguauacgguacaugccaucacaagaaaggagaagcaagaagaaguagacgagcagugacauuaccaagccacucaacgagaaaauuacaaacaagaagucaaacauggcuagaaaguagagaauacacuaaacaucuaauaaaaguagaaaauuggaucuucagaaauccaggauuugcauuaguagcaguugcaauugcaugguuauuaggaucaucaaccagccaaaaaguuauuuauuuaguaaugauccuauuaauugcaccagcauacaguauuagaugcaucggcguuucaaauagagauuuuguugaagguaugucaggaggaacauggguagauguaguauuagaacaugguggauguguaacuguuauggcacaagauaaaccuacaguggacauugaauuaguaacaacaacaguauccaacauggcagaaguuagaucauacugcuaugaagcaagcauaagugacauggcuucagauucaagauguccuacacaaggagaagcauaucuggacaaacaaucagauacucaauaugucugcaaaagaacauuaguugauagaggcuggggaaaugggugcggcuuauucggaaaagguagucuagucacaugcgcuaaauuuacauguaguaagaaaaugacaggaaaaucaauccagccagaaaacuuagaauacagaauuauguugucaguacauggaucucaacauagugguaugauuguaaacgauacaggauacgaaacagaugaaaauagagccaaaguagaaguuaccccuaacucaccaagagcagaagcaacucuaggaggauuuggauccuuaggacuagauugugaaccaagaacaggcuuagauuuuucagaucuauauuaccuuacaaugaacaauaaacacugguuaguacauaaagaaugguuccacgauauaccacuaccauggcacgcaggagcggacaccgguacaccacacuggaauaauaaagaagcauuaguugaguucaaagaugcucaugccaaaagacaaacaguaguaguuuuaggaucucaagaaggagcaguacauacagcuuuagcaggagcauuagaagcagaaauggacggagcaaaaggaaaauuauuuucaggacauuuaaaaugcagauuaaaaauggacaaauugagauuaaaaggcguaaguuauucacuauguacggcagcauucacauuuacuaaagucccagccgaaacacugcauggaacaguuacaguagaaguucaguacgcaggcacagauggaccaugcaaaauaccuguacaaauggcaguagauaugcaaacccuaacaccagucggaagacuuauaacugccaauccaguuauaacagaaucaacugaaaacuccaaaaugauguuagaauuagauccaccauuuggagacaguuauauaguaauuggaguaggagacaagaaaauuacacaucacuggcaucgaaguggaaguacaauaggaaaagcauuugaagcuacaguaagaggagcuaaaagaauggcaguacuaggugauacagcaugggauuuugguucuguaggagguguauuuaauagucuuggaaaaggaauacaucaaauauuuggagccgcauuuaaaucauuauuuggaggaaugucaugguucucacaaauacuaauuggcacauuauuaguauggcuaggacuaaacaccaaaaacggaagcauaaguuuaacaugucuagcacuaggaggaguaaugauauuucuaaguacagcaguaagcgca

SEQ ID NO: 2639 - RNA, 2061 nt, Artificial Sequence
  KX377335.1 prME-short CDS opt
acaucaauaggaauuauuggucuacuucuaacaacagcaauggcugcagaaauaacaagaagaggaagugcauauuacauguauuuagacagaucagacgcuggaaaagcgaucaguuucgcaacaacuuuaggaguaaauaaaugucauguacaaauaauggauuuaggucacaugugugacgcaacuauguccuaugaauguccaauguuagacgaaggaguugaaccagaugauguugauuguugguguaauacaacaucuacaugggucguauauggaacaugucacaggaaaaaaggggaagcaagaagaucuagaagggcaguaaccuuaccaagucauucaacaagaaagcuacaaacaagaagccaaacauggcuagaaaguagagaauacacuaaacacuuaauuaaaguagaaaauuggauauuuagaaauccaggauucgcauuaguugcaguagcaauagcaugguuauuaggcucgucaacaagucaaaaaguuaucuauuuaguaaugaucuuacuaauagcuccagccuauucaauuaggugcaucggcguaucaaauagagacuuuguagaaggaaugagcggagguacauggguagacguaguauuagaacauggaggaugcguaacaguuauggcucaagauaaaccaaccguagauauagaacuaguaacaacaacaguuaguaauauggcagaaguuagaagcuauugcuaugaagcgucuauaucagauauggcaucagauaguagguguccaacacagggagaagcauacuuagacaaacaaucggauacucaauauguauguaaaagaacauuaguagauagaggcugggguaacggaugcggauuauucggaaaaggaucauuagugaccugugcuaaauuuaccugcucaaaaaaaaugacgggcaaaucaauacaaccugaaaaucuagaauaccgcauaaugcuuaguguacauggaucccagcauucaggaaugauaguaaacgauacaggcuacgaaacagaugaaaauagagcaaagguagaaguuacaccuaauucaccacgagcagaagcaacauuaggaggauuuggaagucuagguuuagauugugaaccaagaacaggauuagauuuuucagaucuauauuauuuaacaaugaacaauaaacauuggcuaguacauaaagaaugguuucaugauauaccauuaccuuggcaugcaggugcagauacaggaacaccucauuggaauaauaaagaagcccuugucgaguucaaagaugcacacgccaaaagacaaacuguagucguacuaggaagucaagaaggugcaguacacacagcuuuagcaggagcacucgaagcagaaauggacggagcgaaaggaaaacuguucagcggacauuuaaaaugccgauuaaaaauggacaaauugagacuaaaaggaguaucauacucuuuauguacagcagcauuuacauuuacaaaaguuccagcagaaacauuacauggaacaguaaccguagaaguacaauaugcaggaacugacgguccaugcaaaauaccaguucaaauggcaguagacaugcaaacauuaacuccaguggguaggcuaauuacagcaaacccuguaauaacagaaagcacggaaaacucuaaaaugauguuagaacuagauccaccauuuggagauucauacauaguaauuggaguaggagauaaaaaaauuacacaucauuggcauagaaguggaucaacaauaggaaaagcauucgaagcaacuguacgaggggcaaaaagaauggcaguacuaggcgacacagcaugggauuuuggaaguguuggggguguauuuaauucuuuaggaaaaggaauacaucaaauauuuggagcggcauucaaaucauuauuuggaggaaugagcugguuuagucaaauuuuaauagguacuuugcuaguaugguuaggauuaaauacaaaaaacggaucaauaagccuaaccuguuuggcuuuaggaggaguaaugauauucuuaagcacagcagucagugca

SEQ ID NO: 2640 - RNA, 2061 nt, Artificial Sequence
  LC002520.1 prME-short CDS opt
accagcauaggaauaaucggacuguuauuaacgacagcuauggcagcugaaauaacaagaaggggauccgcguacuacauguacuuagauagaucugaugcuggaaaagcaauaucauucgcuacaacacucggaguaaacaaaugucauguacaaauaauggaucuaggacacaugugugaugccacaauguccuacgaauguccuauguuagaugaaggaguugagccagaugauguagauugcugguguaauacaacuuccacauggguaguauauggcacaugccaucacaagaaaggagaagcuagaagaaguaggagagccguaacacuaccaagccauaguacaaggaaauuacaaacaagaagucagacuuggcuagaaaguagagaauauacaaaacaucugauaaaaguagaaaauuggauauucagaaauccaggauuugcucuaguagcaguagcaauagcaugguuauuaggaagcucaacaagccaaaaaguuaucuauuuaguaaugauauuauuaauagcuccagcguauuccauaagaugcauaggaguaaguaauagagacuuuguagaaggaaugaguggugggacauggguagauguugucuuagaacaugggggauguguaacagugauggcucaagacaaaccaacaguugacauagagcuaguaacuacaacaguaaguaacauggcagaaguaagaucauacuguuaugaagccuccauaucagauauggcauccgacagucgauguccaacacaaggugaagcauauuuggacaaacaaagugauacacaguauguaugcaagagaacauuaguugauagaggaugggguaacggguguggauuauuuggaaaagguucacuggugacaugugcaaaauuuacaugcucaaagaaaaugacuggaaaaagcauacaaccagaaaauuuagaauauagaauuauguuaucaguucacggaagccaacauaguggaaugacuguaaaugacauaggauaugaaacagacgaaaacagagcaaaaguugaaguaacgccaaauucaccuagagcagaagcuacauuaggaggauuuggcaguuugggauuagauugugaacccagaacaggacuugacuucagugauuuauauuaucugacaaugaacaauaaacauugguuaguacauaaagagugguuucaugauauaccauuaccguggcaugcaggagcagacacaggaacuccacacuggaacaauaaagaagcucuaguagaauuuaaagacgcacacgcuaaaagacaaacaguaguagucuuagggucacaagaaggcgcaguacacacagcuuuagcaggagcauuagaagcagaaauggacggcgccaaaggcaaacuauuuucuggccauuuaaaguguaggcuaaaaauggacaagcuaagauuaaaagggguaucauauucauuaugcacagccgccuuuacauuuacaaagguuccagcagaaacacugcauggaacagugacaguagaaguccaauaugcaggaacagauggaccauguaaaauaccaguacaaauggccguagacaugcaaacauuaacaccaguaggaagacucauaacagcaaacccugucauuacagaaagcacagaaaauucuaaaaugaugcuagaauuagauccaccuuuuggagauucuuauaucgugauaggaguuggagauaagaaaauaacacaucauuggcauagauccggaaguacaauaggaaaagcguuugaagccacaguaaggggagcaaaaaggauggcaguacucggagauacagcgugggauuuugggucaguuggaggaguuuuuaauagucuaggaaaagguauacaccaaauauuuggggcagcauucaaaucuuuauucggaggaaugagcugguuuucacaaauauuaauaggcacacuacuuguaugguuaggauuaaauaccaaaaauggaucaauaaguuugacaugccuagcgcuaggagggguaaugauauuucugucaacagcaguaagcgca

SEQ ID NO: 2641 - RNA, 2043 nt, Artificial Sequence
  DQ859059.1 prME-short CDS opt
acaaguauagguauaguaggccuucuacuaacgacagcaauggcagcugaaauaacaagaagagguucagcauauuauauguaucuagauagaagugacgcaggaaaagcuauuagcuucgcaacuacuuuaggaguuaauaaaugucauguacaaauaauggacuuaggacauaugugcgaugcaacaaugaguuaugaaugcccaauguuagaugaaggaguagaaccagacgauguagauugcuggugcaauacuacaucgacauggguaguguacggcacaugucaucacaagaaaggagaagcgagaagaucaagaagggcaguaacacuaccaagccauaguacgagaaaauuacaaacacgaucucaaacaugguuagaaucaagagaauauacaaaacacuuaauaaaagucgagaacuggauauuucggaauccaggauucacccucguugcaguagccauagcuuggcuacuaggauccucaacuagccaaaaaguaauuuauuuaguaaugauauuauuaauagcuccagcauauucaauaagauguauagguguaucuaacagagauuuugucgaaggcaugucaggaggaacauggguagauguaguucuagaacauggaggaugcguaacaguuauggcacaagacaaacccacuguagauauagaauuaguaacgacaacaguaucaaauauggcagaaguacgaagcuauugcuaugaagccucaauaucagacauggcuucagauucaagauguccaacacagggugaagcauaucucgacaaacaaucggacacacaauauguauguaaacgcacauuaguagauagaggaugggguaauggaugcggucuauucggaaaaggaucauuaguaacaugugcaaaauucacuugcucuaagaaaaugacgggaaaaucaauucagccagagaauuuagaauaccguauaauguuaucuguucauggaucacaacauucugggaugauaguaaaugaugaaaauagagcaaaaguagaagugacaccaaauucaccaagagcagaagcuacacuaggaggauuuggaucacuaggauuggauugcgaaccacgaacuggcuuagauuuuucagaucuauacuauuuaacaaugaauaacaaacauuggcuaguacauaaagaaugguuccacgauauaccauuaccauggcaugcuggggcagauacuggaacaccacauuggaauaauaaggaagcauuaguagaauuuaaagaugcucacgcaaaaagacaaacaguagucguguuaggaagucaagaaggagcaguacauaccgcauuagcuggugcacuagaagcagaaauggauggagcaaaaggaagauuauuuucuggacaucuaaaaugccgauuaaagauggauaaacuuagauuaaaagguguuagcuacagucuauguacagcagcauucacauucaccaaaguaccugcagagacccuacacggaacaguuaccguagaaguacaauaugcagggacugauggaccaugcaaaguaccugcacaaauggcaguagacaugcaaacauuaaccccaguaggaagauuaauaacagcuaauccaguaauaacagaaucaacagaaaacagcaaaaugaugcuagaauuggacccaccuuuuggagauaguuacauaguaauaggaguaggagauaagaaaauaacacaucacuggcauaggagugguaguacaauuggaaaagcauuugaagcaacaguuagaggagcuaaaagaauggcagucuuaggagauacagcaugggauuuuggaaguguaggagguguuuuuaauucguuaggaaaaggaauacaucaaauauuuggagccgcuuucaaaagucuuuuuggaggaaugucaugguuuucacaaauucuuauagggacauuauuaguuuggcuuggauuaaacacuaaaaacggaaguauaucuuuaacaugccuagcacuaggagggguaaugauuuuucuaaguacagcaguaagugca

SEQ ID NO: 2642 - RNA, 2049 nt, Artificial Sequence
  KU963573.2 prME-short CDS opt
acgucaauugguauaauaggccuauuacuaacaacagcuauggcggcagaaauuacaagaaggggaucagcauauuauauguaccuagauagaucagaugcagguaaagcuauaaguuuugcuacuacauugggaguaaauaaaugucacguacaaauaauggaucugggucauaugugcgacgcuacaaugucguaugaauguccaaugcuagacgaaggggucgaaccugaugauguagauuguugguguaauacuacaucgacauggguaguauauggcaccugucaucacaaaaaaggagaagcaagaagaucaagaagggcaguaacacuaccaagucauagcacuagaaaauuacaaacaagaagccaaacaugguuagaaagccgagaauauacaaaacauuuaauaaaaguagagaauuggauauuuagaaauccaggauuugccuuaguagcaguugcaauagcauggcuacuuggaucauccacuagucaaaaaguaauauaucuaguaaugauauuauuaauagcaccagcauauaguauuagauguauaggaguuucaaauagagacuuuguugaagguaugucuggaggaacauggguagacguagucuuagaacauggaggauguguaacaguaauggcacaagauaaaccuacaguagauauagaacuaguaacaacaaccguuaguaauauggcagaaguaaggucauauuguuacgaagcaucaauaucugacauggcaagugauagucgaugcccaacacaaggugaagcguauuuggauaaacaaucagauacacaauauguauguaaaagaacucuaguagauagagguuggggcaacggcuguggauuauuuggaaagggaagccuaguaacaugugcaaaauucacuugcaguaaaaaaaugacaggaaaaucaauacaacccgagaaccuagaauauagaauaauguuaucaguacaugggucgcagcacucaggaaugauaggauaugaaacagaugaaaauagggcuaaaguugagguuacgccaaauucuccacgcgcagaagcaacauuagguggauucggcucacuaggacuagauugugagccaagaacaggauuagacuuuagugaucuauauuaucuaacaaugaauaauaaacauugguuaguacauaaagaaugguuucaugacauaccauuaccauggcacgcaggagcugauacaggcacuccgcauuggaauaauaaagaagcacucguagaguuuaaagacgcacacgccaaacgacaaacagugguuguacuaggaucacaagaaggagcaguucacacagcacuagcaggagcacuagaagccgaaauggauggagcuaaagguaaauuauuuaguggacaucugaaaugcagacuaaaaauggacaaacuuagauugaaagguguaaguuauaguuuaugcaccgcagccuuuacuuuuacaaaaguaccagcagaaacacuucauggcacaguaacaguugaaguacaauaugcugguacagauggaccuuguaaaauuccuguacaaauggcagucgacaugcaaacauuaacaccaguuggacgccuaauaacggcuaauccaguaauaacugaaagcacagagaauaguaaaaugauguuagaauuagaucccccauucggagauaguuacauuguaaucggaguuggagauaaaaaaauaacgcaucauuggcacagaagcgguucaacaauaggaaaagcauuugaagcaacagucagaggugcgaaaagaauggcaguccucggcgauacagcaugggauuucgguucagugggaggaguauucaauucucuagggaaagguauacaucaaauauuuggugcagccuuuaaaucauuauuuggaggaaugaguugguuuucccaaauauuaauuggaacauuauuagugugguuagggcucaacacaaaaaacggaaguauaucacuaacuuguuuagcacuaggaggaguaaugauauuuuugucaacugcuguaagcgcu

SEQ ID NO: 2643 - RNA, 2061 nt, Artificial Sequence
  KX694534.2 prME-short CDS opt
acaagcguaggaauaguaggucuauuacuaacgacagcaauggcagcagaaguaacuagaagaggaucggcauauuauauguauuuagacagaaaugaugcgggggaagcaauaucuuuuccgacaacauuaggaaugaauaaauguuauauacaaaucauggaccuuggacauaugugugacgcgacaaugucauaugaauguccaauguuggaugaaggaguagaaccagaugauguugauuguugguguaacacgacaucuacauggguaguauauggcacuugccaucauaaaaaaggagaagcgagaagaagcagaagagcagugacacuaccuagucauucaacaagaaaauuacaaacaagaucacaaacaugguuagaaucaagagaauacacaaaacacuuaauucgaguugaaaacuggauauucagaaacccaggauuugccuuagcugcugcagcaauagcaugguuauuaggcaguaguacaagccaaaaaguaauauaucuaguaaugauccuauuaauagccccagcauauaguauaagauguauugguguaucuaaucgagauuuuguagaaggaaugucaggaggaacauggguagacguaguauuagaacacggaggaugugucacaguaauggcacaagacaaaccaacaguagauauugaauuagucacaacuacaguaagcaauauggcagaaguaagaaguuauuguuaugaagccuccauaucagauauggcaagugacucaagauguccgacucaaggagaagcuuaucuugauaaacaaagcgauacucaguacguaugcaaaagaacacuuguugauagaggcuggggaaacggaugcggauuauucggaaaaggaagccugguaacaugcgcuaaauuugcauguaguaaaaaaaugacaggaaaaagcauacaaccagaaaaucuagaauaucgaauaauguuaucaguacacggcucacagcauucaggaaugauuguuaacgacacaggacacgaaacugacgagaauagagcaaaaguugaaauaacaccaaacucaccgagagcagaagcaacauuaggaggcuucggcagccuaggacuagacugugaaccacgaacaggcuuagacuuuagugaucuauauuaccucacuaugaauaacaaacauugguuaguucacaaagaaugguuccaugauauaccuuuaccauggcaugcaggugccgauacugguacaccacacuggaacaacaaagaagcauuaguagaauuuaaagaugcacaugcaaaaagacaaacaguuguuguauuaggaucacaagaaggagcaguacacacagcguuagcaggggcacuagaagcagaaauggacggggccaaaggacggcuaaguucaggacauuuaaaauguagauuaaaaauggauaaauuaagacuaaaaggaguaucguacucgcugugcacagcagccuuuacauucacaaaaauuccugccgaaacacuacacggaacuguaacaguagagguacaauacgcagguacugauggaccauguaaaguaccagcgcaaauggcaguagauaugcaaacauugacaccaguaggaagauuaauaacagcaaauccaguaauaacagaaucuacagaaaacucaaaaaugaugcuugaauuagauccaccuuuuggagauaguuacauaguaauagggguaggagaaaaaaagauaacccaccauuggcauagaucaggaucaaccauagggaaagcauuugaagccacugucagaggagcuaaaaggauggcaguuuuaggagacacagcaugggauuucggaagcguggguggcgcacucaauagucuuggacgaggaauacaucaaauauuuggugccgcauucaaaagucuuuuuggaggaaugaguugguuuucucagauacuaauuggaacauuauuaauguggcuaggauuaaauacaaaaaauggaaguauuucauugauguguuuagcacuaggaggaguauuaauauuucuaaguacggcaguaagugca

SEQ ID NO: 2644 - RNA, 2061 nt, Artificial Sequence
  KX369547.1 prME-short CDS opt
acaagugucggaauagugggauuacuuuuaacaacagcaauggcugcugaaguaacuagaagagguucagcauacuacauguacuuagacagaaaugaugcaggagaagcaauaaguuuuccgacaacauugggaaugaauaaauguuauauacaaauaauggauuuaggacauaugugugaugcaacaaugucauaugaaugucccauguuagacgaaggcguagaaccagaugauguggauugcuggugcaauacaacaucaacuuggguagucuacggaacaugucaucacaagaaaggugaagcaagaagaagcagacgagcaguaacauuaccuagucauagcacuagaaaguuacaaacacggagucaaacuugguuagagaguagggaauauacaaagcauuuaauaagaguagaaaacuggauauucagaaauccaggucuagcucuagcugcagcugcaauugcauggcuauuaggaucaaguaccucacaaaaagugauauauuuaguaaugauuuuacuaaucgcaccagcauauucaauaagaugcauaggaguuagcaaucgagauuucguagaaggaaugaguggaggaacauggguagauguuguauuagaacacgguggauguguuacagugauggcgcaagauaaaccuacaguagauauagaauuaguuacaacaacuguuagcaauauggcggaaguaagaaguuauuguuacgaagccaguauaagugauauggcaucggacaguagaugccccacacaaggugaagcauaucuagauaaacaaucagauacacaauauguuugcaaaagaacauuaguagacagagguuggggaaaugguugcggucuuuuuggaaaagguagucuaguaacaugcgcaaaauucgccuguagcaagaaaaugacagguaaaaguauacagccugaaaacuuagaguauagaauaaugcuaucaguacacgggagccaacacagcggaaugauuguuaacgacacgggacaugaaacagaugaaaacagagcaaaaguagaaauuacaccgaauagcccucgagcagaagccacacuaggugguuuuggaagccuaggauuggacugugaaccaaggacaggucuagauuuuagugaucuauauuacuuaacaaugaacaauaaacauugguuaguacauaaagaaugguuucaugacaucccuuuaccauggcaugcaggagcagauaccggaacuccacauuggaacaauaaagaagcauuaguagaauuuaaagaugcacacgcaaagagacaaacaguaguaguauuaggaagccaagaaggagccguacauacagccuuagcaggcgcguuagaagcagaaauggauggagcaaaggguagauuaaguucgggacauuugaaauguaggcucaaaauggauaaauuacgauugaaaggaguaaguuacucuuuguguacagcagcuuuuacuuuuacaaaaauaccagcagaaacauuacaugguacagucacuguggaaguacaauaugcaggaacagauggaccaugcaaaguaccugcacaaauggcaguagacaugcaaacacuuacaccgguagguagauuaauaacagcuaauccaguaauaaccgaaaguacagaaaacagcaaaaugauguuagaauuagacccgccauuuggagauucauauauaguaauuggaguaggagaaaagaaaauaacacaccauuggcauagaucaggaaguacuauagguaaagcguucgaagcuacaguaagaggagcaaaaagaauggccguguugggcgacacugcaugggacuuuggaucgguuggaggugcacuaaauucauuagguaaaggcauucaccaaauauuuggagcagcauuuaagucauuauuuggaggaaugagcugguuuucacaaauacuaauuggaacguuauuaauguggcuaggauuaaauacuaaaaaugguagcauuaguuuaaugugucuagccuugggaggaguguuaaucuuccuuaguacagcaguuagugcu

SEQ ID NO: 2645 - RNA, 2061 nt, Artificial Sequence
  KX447515.1 prME-short CDS opt
acaucaguagguaucguaggauuacuauuaacaacagcaauggcagcagaaguuacgagaagagguucagccuacuauauguaucuugauaggaacgaugcaggggaagcuaucaguuuuccuacaacauuaggaaugaacaaaugcuauauucaaauaauggauuuaggacauaugugugacgcuacuaugagcuaugaauguccuaugcuagacgaaggcguagaaccugaugacguagacuguugguguaauacaacaucgaccuggguaguguauggaacgugucaucauaagaaaggagaagcaagaagaagcagacgagcuguaacauuaccaucacauaguacaagaaaauuacaaacacgaucacaaacauggcuagaaaguagagaauauacaaaacauuuaauuagaguugaaaauuggauauuuaggaauccagguuuugcauuggcagcagcugcaauugcguggcugcucggcaguucaacaucacaaaaaguaauauaucuaguaaugauauugcuaauagcuccagcuuauucaauaagaugcauaggaguuucaaauagagacuuuguugaaggcaugaguggaggcacauggguagacguaguauuagaacacggaggaugcgugacuguaauggcacaagauaaaccaacaguagauauugaguugguaacaacaacagugucaaauauggcagaaguaagaaguuauuguuacgaagcuagcauaagugauauggcaucagacagcagauguccuacucaaggcgaagcauaucucgacaaacaaagugauacacaauacguauguaaaaggacacuggucgacagaggguggggaaacggcugugguuuguuuggaaaaggaagucuaguaaccugugcaaaauuugcuuguaguaaaaagaugacgggaaagaguauccaaccagaaaacuuggaauauagaauaauguuauccgugcacgggagucaacauucaggaaugauaguaaacgauacaggacaugaaacagacgaaaauagagcaaaaguggaaauuacuccaaauaguccaagggccgaagcuacucuuggcggauuuggaucauuaggauuagacugcgaaccgaggacaggacuagauuucagugauuuguacuaucuaacaaugaacaacaaacauugguuaguccauaaagaaugguuccaugauauuccauuaccguggcaugcuggugcggauacuggaacaccacauuggaauaauaaagaagcauuaguagaauuuaaagaugcucaugcaaaaagacaaaccguaguaguuuuagguagucaagaaggagcaguacacacagcauuggcgggagcccuagaagcagaaauggauggagcaaaagggagacuaucuucaggacacuugaaauguagauugaaaauggauaaacucagauuaaaagggguaucauauucauuauguacagcugcauucacauuuacaaaaauaccagcugaaacacuacaugguacuguuacgguagaaguacaauaugcaggcacagacggaccuuguaaaguuccagcacaaauggcaguagacaugcaaacauuaacaccuguaggaagauuaauaacagcaaauccagugauaacagaaucaacagaaaauaguaaaaugauguuagaauuagauccaccauuuggcgauucauauauaguaauagguguaggagaaaagaaaaucacccaccauugguauagaagcggaagcacaauagguaaagcauuugaagcaacaguaagaggagcaaaaaggauggccguucuaggagacacugcaugggauuuuggaaguguaggaggagcacuaaacucuuuaggaaaagguauucaucaaauauuuggagcagcauuuaaaucguuauucggaggaaugagcugguuuucacaaaucuuaauaggaacauuacuaauguggcuuggauugaauaccaaaaauggaucgauaucuuuaaugugucuagcacuagggggaguuuuaauauuucuaucaacagcagugagugca

SEQ ID NO: 2646 - RNA, 2061 nt, Artificial Sequence
  KU729218.1 prME-short CDS opt
acgucuguuggaauaguuggauuauuacuaacaacagcaauggcagcagaaguuacaagaagaggcucagccuauuacauguacuuagauagaaaugacgcaggagaagcuauuagcuuuccgacuacucuaggaaugaauaaaugcuacauacaaauaauggacuuaggacacaugugcgaugcaacaaugaguuacgaauguccaaugcuagacgaggguguugaaccggaugauguagauuguugguguaacaccacaagcacuugggugguauauggaacgugucaccacaaaaaaggagaagcacguagaucacgaagggcaguaacacucccaucacauaguacuagaaaauuacaaacaagaagucaaacgugguuagaaucaagagaauacaccaaacacuuaauuagaguagaaaauuggauauuucgaaauccagguuuugcucuagcagcagcagcaauagcaugguuauuaggaagcucgacaagucaaaaaguaauauauuuaguaaugauacuauuaauagcuccggcuuauucaauaagauguauaggaguaucaaauagagacuuuguagaaggaaugucuggaggaacuuggguugaugugguauuagaacaugggggauguguaacaguaauggcccaagauaaaccaacaguugauauagaacuuguuacaacaaccguaaguaacauggccgaaguaagauccuauugcuaugaagcaucaauaucggauauggcaagugauucaagauguccuacucaaggagaagccuacuuagacaaacaaagcgauacacaauauguaugcaaaaggacacuaguagaucgugguuggggaaacggauguggauuguucggaaaagguagccucguaacaugugcaaaauuugcuuguaguaaaaaaaugacaggaaaaucaauacaacccgaaaauuuagaauauagaauaaugcuaaguguccacgggagccaacauagcgguaugauaguuaacgauacaggacaugaaacugaugaaaauagggcaaaagucgaaauaacaccaaauaguccaagagcagaagcaacauuagguggauuuggaucuuuaggacuagacugugaaccaaggacugguuuagauuuuagcgacuuauauuaucuaacaaugaacaauaaacauugguuaguacauaaagaaugguuccaugauauaccauuaccauggcacgcaggagcagauaccgguaccccgcacuggaauaauaaagaagcacuaguugaauuuaaagacgcacaugcaaaacgucagacaguaguaguauuaggaagucaagaaggcgcaguacauacagcauuagcaggagcacuugaagcggaaauggauggugcaaaaggaagauuaaguucaggacauuugaagugucgguuaaaaauggacaaacuaagauuaaaaggaguaucauauucgcuauguacagcugcuuuuacauucacuaaaaucccagcugaaacacuacauggaacaguaacaguagaaguucaauaugcagguacugacggaccaugcaaagucccagcacaaauggcaguggauacacagaccuuaacacccgugggaagacuuauuacugcaaauccaguaauaacugaaucaacugaaaauucaaaaaugauguuagaauuagauccaccauuuggagacucguauaucguaauugguguaggagaaaaaaaaauaacucaucacuggcauagaucaggaucaacaauaggaaaagcauucgaagcuacaguaagaggcgcaaaaagaauggcaguccuaggagauacugcaugggacuucggaagcguaggaggcgcacuuaauucucuagguaaaggaauacaucaaauauuuggagcagcauuuaaaagcuuauuuggaggaauguccugguuuucacaaauacuaauaggaacuuuguuaauguggcuuggucuuaauacaaaaaaugggucaauaaguuuaaugugccuagcuuuaggaggggucuuaauauuucuuuccacugcaguaagugca

SEQ ID NO: 2647 - RNA, 2061 nt, Artificial Sequence
  KU501217.1 prME-short CDS opt
acaucaguuggcauuguaggauuacuauuaacaacagcuauggcagcagaaguaacacgaaggggaucagcauauuauauguaucuagauagaaacgaugcaggagaagcaaucagcuucccaacaacacuagggaugaauaaauguuauauacaaauuauggauuugggccacaugugugacgcaacaaugaguuaugaaugcccaaugcuugacgaaggaguugaacccgaugauguagacugcugguguaauacaaccucaacuuggguaguuuauggaaccugucaucacaagaaaggagaagcucgaagaucaagacgagcaguaacauuaccuagucauucaacgagaaaauuacaaacuagaucacaaacuuggcuugaauccagagaauacacaaaacaucuaauaagaguugaaaacuggaucuuuagaaacccugguuuugccuuagcagcggcugcaauagcaugguuacuaggaucaucaacaagucagaaagucauauauuuagucaugauauuacuaauagcuccugcauacucuauaagauguauaggugugaguaauagagacuuuguggaaggaaugucugguggaacauggguggacguaguuuuagagcacgggggaugcguuacaguaauggcccaagauaaaccaacaguugauauugagcuaguaacaacgaccguaagcaauauggcagaaauaagaucauauugcuaugaagccucaauuagugacauggcuagcgauagcagaugcccaacacagggagaagcauaccuggacaaacaaucagacacacaauauguaugcaaaagaacauuaguagacagaggauggggaaaugguuguggacuauuuggaaaagggucauuaguaacaugcgcaaaauuugcauguucaaagaaaaugaccgguaaaucaauacaaccagaaaauuuagaauacagaauaaugcuaucaguacacgguagucaacauagcgggaugauuguaaacgauacaggacacgaaacagaugaaaaucgcgcaaaaguagaaauaacgccaaauaguccuagagcugaagcaacauuggguggauuugggaguuuaggacuagauugcgaaccuagaacaggacuagauuuuagugacuuauauuaucucacaaugaauaauaaacacugguuaguucacaaagaaugguuucaugauauaccauuaccauggcaugcaggagcagauacagguacaccccauuggaacaauaaagaagcucuaguagaguuuaaagacgcacaugcaaaacgacaaacaguaguaguuuuagguagucaagaaggcgcagugcauacagcacuagcaggagcauuagaagcagaaauggacggugcgaaaggucgauuaaguaguggacauuuaaaaugccgacuaaaaauggacaaauuacgauuaaaagguguaucauacucauuauguaccgcugcauucacuuuuacaaaaauaccugcagaaacauugcacggaacuguaacaguagaaguacaauaugcggguacagauggaccaugcaaaguuccagcccaaauggcuguggauaugcaaacacuaacaccaguagguagacuuauaacggcaaauccaguaauaacagaaaguacagaaaauucaaaaaugauguuagaauuagaucccccauuuggagacagcuauauaguuauaggaguaggagagaaaaagauaacucaucauuggcaucgaagcgguucaacaauuggaaaagcauuugaagcaacuguaagaggagcaaaaagaauggccgucuuaggggacacugcuugggauuucggaucaguaggcggugcauuaaauucacuaggaaaagguauucaccaaauauuuggagcagcauucaaaucauuauucggaggcaugaguugguucagucaaauacuaauaggaacauuacuaauguggcuuggacuaaacacuaaaaaugguucaauaaguuuaaugugucuugcauuaggcggcguacuuauauuuuuaucaacagcaguaucagca

SEQ ID NO: 2648 - RNA, 2061 nt, Artificial Sequence
  KU312314.1 prME-short CDS opt
accucaguagguauaguuggauuacuacuaacaaccgcaauggcugcagaaguaacaagaagaggaucagcauauuauauguauuuagacagaaacgaugcaggggaagcgauaucuuuuccaacaacuuuagggaugaauaaauguuacauacaaauaauggaccuaggucacaugugugaugcaacuaugucauaugaaugcccaaugcucgaugaaggaguagaaccagacgacguagacuguugguguaauacaacuucaacauggguaguauauggcacaugccaucauaagaaaggagaagcaagaagaucacguagagcaguaacauugccaucacauucuaccagaaaacuacaaacaagaagccaaacaugguuagaaucaagagaauacacaaaacacuuaauaagaguagaaaauuggauuuuuagaaacccagguuucgcuuuagcugcagcagcuauagcuuggcuauuagggaguagcacaucacaaaaagucauauaucuaguuaugauccuccugauagcaccagcauauaguauacgauguauaggaguaucaaacagggacuucguugaaggaaugaguggaggaacuuggguagauguuguucuagagcauggaggcuguguaacuguaauggcacaagacaaaccaacaguagacauagagcuaguaacaacuacuguaagcaauauggcugaaguaagaucuuauugcuaugaagcaagcauaucagauauggcaagugacagucgauguccaacccaaggagaggcuuauuuagauaaacaauccgauacucaauauguuuguaaacgaacccuaguggacagaggaugggguaacggauguggacuauuugggaaaggaagccucgugacaugugcaaaauuugcuuguucgaaaaagaugacaggaaaaucaauacaaccugaaaaucuagaauauagaauaaugcuaucuguacacggaagccaacauaguggaaugauaguaaaugacacaggucaugaaacagacgagaacagagcaaaaguugaaauuacgcccaauagcccucgagcagaagcuacacuagggggauuugguucucuaggacuagacugugaaccaagaacaggccuagauuuuucagaccuauauuauuuaacaaugaauaauaaacacuggcuaguccauaaagaaugguuccacgauauaccauuacccuggcacgccggagcagacacaggaacaccucacuggaauaauaaagaagcccuuguagaauuuaaagaugcacacgcaaaacgucaaaccguaguaguauuaggcagucaagaaggagcaguucauacagcauuagcuggagcauuagaagcagaaauggacggagcaaagggcagacuauccucaggacaucuaaaaugcagauugaaaauggauaaacuacgauuaaaaggaguaaguuauucacuguguacagcagcauuuacguuuacaaaaauaccagcagaaacauuacacggaacagucacaguagaaguucaauaugcaggaacagacgguccauguaaaguauuagcacaaauggcuguagauaugcaaacacuaacaccuguaggaagauuaauuacugcaaauccuguuaucacugaaagcacagaaaacucaaaaaugaugcuugaauuagauccaccauuuggcgauucauacaucgucauuggaguaggagaaaagaaaauaacgcaucacuggcaccgaaguggaucaacaauagguaaagcauuugaagcaacaguacguggagcuaaaagaauggcaguuuuaggagauacagcuugggauuuuggaagugucgguggagcacuaaacucacuaggaaaaggaauacaucaaauauuuggagcagcauucaaaucauuauuuggaggcaugucaugguuuagucaaauuuuaauaggaacucuacuaaugugguuaggauuaaacacuaaaaacgguucaauauccuuaaugugucuagccuuaggaggaguucuuauauuucucagcacagcuguaagugcu

SEQ ID NO: 2649 - RNA, 2061 nt, Artificial Sequence
  KX446950.2 prME-short CDS opt
acgaguguaggaauaguaggauuguugcuaacaacagcuauggcugcagaaguaacuagaagaggcagugccuacuacauguacuuagacagaaaugacgcuggugaagcaauuagcuuuccaacaacacuaggaaugaacaaauguuauauacaaauaauggacuuaggccauaugugugaugcaaccaugucauacgaguguccaacauuagacgagggcguugaaccagacgacguagauugcugguguaauaccacuucaacauggguaguauaugguacuugucaccauaagaaaggugaagcaagaagaucacguagagcagugaccuuaccuucacauucuacaagaaaauuacaaacaaggagucaaacauggcuugaaucaagagaguauacaaaacaccuaauaaggguugaaaauuggauauuucgaaacccgggguuugcacuagccgcagcugcaauagcauggcuccuaggaaguucaacuagccaaaaaguaauauaccuaguaaugaucuugcuuauagccccagcauacaguauaagauguauuggagugaguaauagagauuucguagaaggaaugucaggagggacuuggguugauguaguauuagaacauggaggaugcguaaccguaauggcacaagauaaaccgacgguugauauagaauuaguaaccacaacaguaaguaauauggcugagguaagaaguuacuguuaugaggcaucaauaucagacauggccagcgacagucguuguccaacgcaaggagaagccuauuuagacaaacaaucagauacacaauauguauguaaaagaacucuaguugauagaggauggggaaacggcugcggacuuuuuggaaaaggaucauuagugacaugcgcaaaauuugccuguaguaagaaaaugacagguaaaucuauacaaccugaaaauuuagaauauagaauuauguuaucaguacacggaucacaacauucggggaugauaguaaaugauaccggacacgaaacagaugaaaauagagcuaaaguugaaaucacaccaaacaguccaagagcagaagcaacauuaggcggauucggaucacuaggccuagauugugaaccaagaacaggacuagauuuuagcgaucuuuauuacuuaacaaugaauaauaaacauugguuaguucauaaagaaugguuucaugauauaccccuuccauggcaugccggagcagauacuggaacaccacacuggaauaacaaagaagcauuagucgaauuuaaggaugcacaugcaaaaagacaaacuguuguaguauuaggaucacaagaaggagcaguacauacagcuuuagcuggagcacuagaagcugaaauggacggagcaaaaggacgauuaagcucuggacaccuaaaauguagacuaaaaauggauaaacuaagacucaaaggaguuucuuauucguuauguacugcagcauuuacuuuuacaaaaauuccagcagaaacgcuacauggaacaguaacuguagaaguacaauaugccggaacugauggaccauguaaagucccagcacaaauggcaguugauaugcaaacacuaacuccaguaggaagauuaauaaccgcuaauccagucauaacagaaucaacagaaaauucaaaaaugauguuagaauuggauccucccuuuggugacaguuacauaguaauaggaguaggagaaaagaaaauaacacaucacuggcauagaaguggaucaacuauagguaaagcauuugaagcuacaguacgaggagcaaaaagaauggccguucuuggagacacagcuugggacuuuggaaguguaggaggagcucuaaauagcuuaggaaaggguauacaucaaauauuuggagccgcuuuuaaaagucuauucggaggaaugucaugguuuucacaaauauuaauaggaacacuacuaaugugguuaggacuaaauacgaaaaauggcagcauuagcuuaauguguuuagcacuaggaggaguucuaauauucuuaucaacagccguaagugca

SEQ ID NO: 2650 - RNA, 2061 nt, Artificial Sequence
  KY003157.1 prME-short CDS opt
acaucaguaggaauagugggauuacuuuuaacaacggcaauggcagcugaaguaacaagaagaggcagugcuuauuauauguauuuagacaggaaugaugcaggugaagcaauuaguuuuccuacaacuuuaggcaugaacaaauguuacauacaaauaauggaucuaggacauaugugcgaugcaacaaugucauaugagugcccuauguuagaugaagguguugaaccagacgauguggauugcugguguaauaccaccagcacuuggguaguauacggaacaugucaucauaaaaaaggcgaagcaagaagaaguaggagagcuguaacucucccuagucauucuacgagaaaauuacaaacaagaucacaaacuuggcuugaaucaagagaauauacaaaacauuuaauacgaguagaaaacuggauauuuagaaauccagguuucgcacuggcagcagcagcaauagcaugguuacuaggaucaucaacaagccaaaaaguaauauacuuaguaaugauucuguuaauagcaccagcguauagcauccguuguauagguguaucaaauagagauuuugucgaaggaaugaguggaggaacauggguugauguaguucuagaacacggaggcugcgucacagucauggcacaagauaaaccaacgguagauauugaauuaguaacaacaaccgucagcaacauggcagaaguaagaucauacuguuaugaagcaucaauauccgauauggcaucagacucuagauguccaacucagggagaggcauauuuagauaaacaaucagauacgcaauauguauguaaaagaacauuaguagauagaggguggggcaauggauguggauuauuuggaaagggaucuuuaguuacuugugcaaaauuugcaugcucaaaaaaaaugacaggaaaaaguauucaaccagaaaauuuagaauaccgaauaaugcuuaguguacacggaagucaacauucaggaaugaucgucaaugacacagggcacgaaacagacgaaaacagagcaaaaguagaaauaacaccuaauucuccaagagcagaagcaacuuuagguggauucggaagcuugggccuugauugugaaccaagaaccgggcuugauuuuagcgauuuauacuauuuaacaaugaauaauaaacauugguuaguacauaaagaaugguuccaugauauaccucuaccauggcacgcaggugcagauacaggaacaccacacuggaacaauaaagaagccuuaguugaauuuaaagaugcacaugcgaaaagacaaacagucgucguacuaggaagucaagaaggagcaguacauacugcucuugcaggggccuuagaagcagagauggauggagcaaaaggaagauuaucuucgggacaucucaaauguagauuaaaaauggauaaauuaagacuaaaaggugucuccuacagucuauguacggcagcauucacauuuacaaaaauaccugcagaaaccuuacauggaacaguaacagucgaaguacaauaugcaggaacagaugguccauguaaaguaccagcacaaauggcaguugauaugcagacauuaacacccguaggaagauuaauaacagcaaauccagucauaacugaaucaacagaaaacaguaaaaugauguuagaauuagauccgccauucggagauaguuauauaguuauuggagucggugaaaaaaaaauaacucaccauuggcacagaucaggaucaacaauaggaaaagcauuugaagcaacaguaagaggagcaaaaagaauggcaguguuaggagauacugcaugggauuuuggaaguguaggaggagccuugaauucauuagguaaagguauacaccaaauauuuggggccgcauuuaaaagcuuauuuggaggaaugaguugguuuucacaaauucuaauaggaacauuauuaauguggcuuggauuaaauacuaaaaacgguucuauuucacuaauguguuuagcauuaggcgggguucuaauauuucuuucuacggucguuucagca

SEQ ID NO: 2651 - RNA, 2061 nt, Artificial Sequence
  KX811222.1 prME-short CDS opt
acaucaguugguauaguuggacuacuauuaacaacagcgauggcagcugaaguaacaagaagaggaucagcauauuacauguacuuagauaggaacgaugcuggugaagcaauuucauuuccuacaacacuaggaaugaauaaauguuauauacaaauaauggaccuaggucauaugugcgaugcuacuaugucuuaugaaugcccaaugcuagaugaaggaguagaaccagaugauguagacuguugguguaacacaaccagugcauggguaguauaugguaccugccaucacaagaaaggagaagcuagaagaucuagacgagcuguaacauuaccuagccauucaacgagaaaauuacagacaagaccacaaacuuggcuagaaucuagagaauacaccaaacaucuaauaaggguagaaaauuggauauuuagaaauccagguuuugcacuagcugccgcagcaauugcuugguuacuagguucaucaacaucucaaaaaguaaucuaucuaguuaugaucuuacuaauagcuccugcauauaguauaagaugcauaggaguaagcaacagagauuuuguagaagguaugucagguggaacauggguugauguaguacuugaacacgguggaugugugacuguaauggcacaggauaaacccacaguggacauagaauuaguaacaacaacugugucaaauauggcugaaguaagaucauacugcuaugaagcaucaauuagugauauggcauccgauaguagauguccuacacaaggagaagcauaucuagauaaacaaagugacacacaauaugucuguaaaagaacguuaguugauagaggauggggaaauggaugcggauuauuuggaaaaggaucacuuguaaccugugcaaaauuugcauguucaaagaaaaugacaggcaaaaguauacaaccagaaaaucuagaauauagaauaauguuaucgguccauggaucacaacauagcgguaugauuguaaaugauacaggacacgaaacagacgaaaauagggcaaaaguugaaaucaccccaaacucacccagagcagaagcaacucugggaggauuuggcagccugggauuagauugugaaccaagaacuggacuugauuuuagugaucuauacuaucuuacaaugaacaauaaacauuggcucguacauaaagaaugguuccaugauauaccauuaccuuggcaugcaggagccgauacaggaacaccacacuggaacaauaaagaagcauuaguagaguucaaagacgcacaugcaaaaaggcaaacaguaguuguacuaggaagccaagaaggagcaguucauacugcauuagcgggugcauuagaagccgaaauggauggagcgaaagguagauuaucuucuggacacuugaaaugucgcuuaaaaauggauaaacuaagacuaaaaggaguaaguuacucauuaugcacagcagcauucacauuuacaaaaauuccugcggaaacacuacacggaacuguaacaguagaaguacaauaugcuggaacugauggaccauguaaaguucccgcacaaauggcaguugacaugcaaacauuaacaccgguaggaagauugauuacugcgaacccuguuauaacagaaaguacggaaaauaguaaaaugaugcuagaauuagauccaccuuuuggagauaguuauauaguaauaggaguaggugaaaagaaaauaacacaucauuggcacagaagcggaucaacaauaggaaaagcauuugaagcuacaguuagaggagcuaaacgaauggccguacuuggagacacagccugggauuuuggcuccguaggaggagcauuaaacagucuagguaaaggcauacaucaaauauuuggagcagccuuuaaaaguuuauuuggagguaugucaugguuuucacaaauacuaauaggaacauuauuaauguggcuaggacuaaacacuaaaaauggaucgauaagccuuaugugcuuagcacuaggagguguuuuaauauuucuaagcacagcagugucagcu

SEQ ID NO: 2652 - RNA, 2061 nt, Artificial Sequence
  KX447516.1 prME-short CDS opt
acaucugugggaauaguagguuuauuauuaacuaccgcaauggcugccgaaguaacaagaagaggaucagcauauuauauguaccuugauagaaaugaugcaggagaagcaauaucuuuuccaacaacauuagguaugaauaaaugcuacauacaaauuauggauuuaggacauaugugugaugcaacgaugucauaugaauguccaaugcuugaugaaggaguugaaccugacgauguagauuguugguguaauacaacaagcaccuggguuguauauggaacaugucaucauaaaaaaggagaagcucgaagaaguagaagagcaguaacccuaccgagccacagcacuagaaaauuacaaacuaggucacaaaccuggcuagaaaguagagaauacacaaaacaucuuauaagaguagaaaauuggaucuuuagaaauccagguuucgcacuagcagcagcagcaauagcauggcuacuagguucguccacaucaaaaaaaguaauauauuuaguaaugauauuacuaauagcaccagcauauucaauaagauguauagguguaaguaauagagauuucguugaaggaaugaguggaggaacauggguagauguagucuuagaacacggaggaugugugacuguuauggcacaagacaaaccaacaguagacauagaacuuguaacgacaacaguaagcaauauggcagaaguacguaguuauugcuaugaagcaucaauuucagauauggcaucagauuccagauguccaacacaaggagaagcuuauuuagauaaacagucagauacgcaauauguuugcaaacgaacccuaguugacagaggguggggcaacggaugcggauuguucggaaaaggaucguuaguaacuugugccaaauucgcauguucuaaaaaaaugaccggaaaaucaauacaaccagaaaauuuagaauauagaaucaugcuaagcgugcauggcucacaacacucuggcaugauuguaaaugauacaggacaugaaacugacgagaauagagcuaaaguagaaauaacaccgaauucacccagagcagaagcaacauuaggaggauucggaucacugggauuagauugcgaaccacgaacaggauuagauuucagugaccuuuauuauuuaacaaugaauaauaaacauugguuaguacauaaagaaugguuccacgacauaccauuaccuuggcaugcaggcgccgauacaggaacaccacauuggaauaauaaagaagcucuaguagaauuuaaagaugcacaugcaaaaaggcaaacaguagucguucuaggaucacaagaaggagcaguacauacagcauuagcaggagccuuagaagccgaaauggauggcgcaaaaggaagacuaagcagcggacauuugaaaugucgguuaaagauggacaaguuaagguuaaaaggcguuagcuacaguuuauguacagcagcauuuaccuucacaaaaaucccugccgaaacauuacauggaacaguuacaguagaaguucaauaugccgggacugacggaccauguaaaguaccagcucaaauggcaguagacaugcaaacauuaacaccuguuggaagacuaauaacagcaaauccagugauaacugagaguacagaaaacaguaaaaugauguuagaauuggacccuccauucggugacagcuauaucguaauaggaguaggugaaaaaaaaauaacacaucacuggcacagaucaggaucaacaauagguaaagcauucgaagcaacaguacguggagcaaaacgaauggcgguucuaggagauacugcgugggauuucggaagcgucggaggggcauuaaacucauuagggaaaggaauucaucaaauauuuggugccgcauuuaaaagccuauuuggagguaugaguugguuuagucaaauauuaauuggaacacuccuuauguggcucggauuaaauacuaaaaacggaucuauuaguuuaauguguuuggcauuaggugguguacuuauauuuuuaaguacagcaguaucagca

SEQ ID NO: 2653 - RNA, 2061 nt, Artificial Sequence
  KX520666.1 prME-short CDS opt
acgaguguagguauaguaggauuauuacuaaccacagcuauggccgcagaaguaaccagaagaggaagugcauacuauauguacuuagaucggaaugaugcaggggaagccauaagcuuuccaacaacucuagguaugaauaaaugcuauauacaaauaauggacuuaggacauaugugugaugcgacaaugagcuaugaauguccaaugcuagacgaaggcguagaaccagaugauguugacugcugguguaacacaacaaguacauggguaguauacgggacaugucaccauaaaaaaggcgaagcgcgaagaucaagaagagcaguuacauuaccaagucauuccacuagaaaauuacaaacccguucacaaacauggcuugaaucacgagaauacacaaaacaucuuauucguguagaaaacuggauauuccgaaauccgggauuugcacuagcagcagcagcaaucgcaugguuauuaggaaguucuacaagacaaaaaguuauauaccucguaaugauacuuuuaauagcaccagccuauagcauaagauguauaggaguauccaacagagauuucguugaaggaaugaguggaggaacauggguagacguagucuuagaacauggaggauguguaacaguaauggcucaagauaaaccuacaguugauauagaacucguaacaacuacaguaaguaauauggccgaaguccguucauauuguuaugaagcaucaauaucagauauggcgagcgacaguagauguccuacccaaggagaagcauauuuagacaaacaaagugauacacaauaugucugcaaaagaacauuaguggacagagguugggguaauggaugcggacuauucggaaaaggaaguuuaguaacaugugccaaauuugccuguucaaagaaaaugacaggaaaaucaauacaaccagaaaacuuagaauauagaauuauguuaucaguccauggcucacaacacagugggaugauagucaacgacacaggacaugaaacagaugaaaauagagcuaaaguagaaauuacaccaaauucaccccgagcggaagcaacacuaggaggauuuggaucacuaggauuagauugugaaccuagaacagguuuagacuuuagugauuuauacuaucuuacaaugaacaauaaacacugguuaguacacaaagagugguuccaugacauaccacuuccauggcaugcaggagcagacacggggacgccacauuggaauaauaaagaagcauuaguagaauuuaaagaugcacaugcgaaaagacaaacgguaguaguacuagguagccaagaaggagcaguacacacagccuuagcaggugcauuagaagcagaaauggacggagcuaaaggacgguuaucaagugggcacuuaaaaugcagacuaaaaauggacaaauuaagauuaaaaggaguaagcuacucauuaugcacagcagcauuuacauucacuaaaauccccgcagagacuuuacauggcacagugaccguagaaguacaauacgcaggcacagauggaccauguaaaguuccugcacaaauggcuguagauaugcaaacguuaacaccaguugguagauuaauaacugcaaauccuguaauuaccgaguccacggaaaauucaaaaaugaugcuagaauuagacccaccauuuggagauucuuauauaguaauaggagucggagagaagaaaauaacucaucauuggcauagaagcggaaguacaauaggaaaagcauuugaagcaacagucagaggagccaaaagaauggcaguucuaggagacaccgcuugggauuuuggaucaguaggaggugccuuaaauucucuaggaaaaggaauacaucagauauuuggugcagcauuuaaaaguuuauucgguggaaugucgugguuuucacagaucuuaauaggaacgcugcuaauguggcuaggacuaaauacaaaaaauggaucaauaucauuaaugugucuagcauuagguggcguacuaauauuuuuaucaacagcaguaucagca

SEQ ID NO: 2654 - RNA, 2061 nt, Artificial Sequence
  KU497555.1 prME-short CDS opt
acaagugucggcauaguaggucucuuacugacaacagcgauggcagcagaaguaacaagaagaggcagugcauacuacauguauuuagauaggaaugaugccggggaagcaauaucauucccaacaacuuuagguaugaauaaauguuauauacaaauaauggauuuggggcauaugugugacgcuaccaugaguuacgaauguccaaugcuugaugaaggugucgaaccagaugauguagauuguugguguaauacaacuaguacauggguaguuuauggaacuugucaucacaaaaaaggagaagcgagaagaagcagaagagcugugacacuccccucccauaguacuagaaaacuacaaacacgaagccaaacaugguuagaaucaagagaauauacaaaacauuuaauaagaguagaaaauuggauuuuuagaaauccaggauuugcauuagcugcagcugcaauagcauggcuccuggguucaucaacuagucagaaagugauuuauuuaguuaugauacuacuaaucgcacccgcguauucaauaagguguauagguguauccaacagagauuucguagaaggaaugucuggaggaacauggguugauguaguuuuagaacacgguggguguguuacaguaauggcucaagacaaaccaacuguagauauugaacuaguaacaacuacuguaagcaauauggcagaagucagaaguuauuguuacgaagccucaauaagcgacauggcuucagauucuagauguccaacacaaggggaagcauauuuagauaaacaaucagauacacaauaugucugcaaaagaacacuagucgacagaggaugggggaacgguugcggguuauucggcaaaggaucauuaguuaccugcgcaaaauucgcauguagcaaaaaaaugacggguaaaaguauacaaccagaaaaucuugaauauagaauaaugcuaucuguucacgguucacaacauaguggaaugauagucaaugauacaggacaugaaaccgaugaaaacagagcaaaaguugaaaucacaccaaauucaccucgagcagaggcuacauuaggaggcuuugguagucuuggauuagacugugaaccgagaacaggauuagauuuuagugauuuauauuauuuaacaaugaauaauaaacauuggcugguacacaaagaaugguuucaugauauuccacuuccauggcacgcaggugcagauacagguacaccgcacuggaauaacaaagaagcauuagucgaauuuaaagacgcacaugcaaaaagacaaacaguaguuguuuuaggcacucaagaaggugcaguccauacggcacuagcgggggcacuagaagcagaaauggauggugcuaaaggaagacuaaguucaggacauuuaaaauguagauuaaaaauggauaaauuaagacuaaaaggaguaucauauucauuauguacagcagcauuuacauuuacgaaaauuccagccgaaacccuacacgguacuguuacuguagaaguccaauaugcagguacagauggaccauguaaaguaccugcgcaaauggcaguagauaugcaaacacuuacaccaguaggaagauuaauaacugcgaauccaguaauaacggaauccacagaaaauucaaagaugauguuagaauuagauccaccuuuuggagauucauacauaguaaucggaguuggugaaaaaaaaauaacacaucauuggcauagaucaggcucaacaauaggaaaagccuuugaggcaacaguaagaggcgccaaaagaauggcaguccuaggugacacagcaugggauuuuggaucuguaggaggagcauuaaauucccuaggaaaaggaauacaccaaauuuuuggagccgcuuuuaaauccuuauuuggaggaaugucaugguuuucacaaauucuaauuggaacacuauugaugugguuaggcuuaaacacaaaaaacggaagcaucaguuuaaugugucuggcacucggaggaguacuaauauuccuaucaacagcaguuagcgca

SEQ ID NO: 2655 - RNA, 2061 nt, Artificial Sequence
  KY075939.1 prME-short CDS opt
acuucuguaggaauaguaggccuauuguuaacaacugccauggccgcagaagucacaagaaggggcagcgcauacuauauguauuuagauagaaacgaugcaggagaggcaauuucauuuccaacaacacuaggaaugaauaaauguuauauacaaauaauggaucuuggucauaugugugacgcaacaaugucguaugaauguccuaugcuugacgaagguguugaaccagaugauguagauuguuggugcaauacaacaucaacuuggguaguauacggaaccugucaucauaaaaaaggagaggcaagaagaucaagaagagcaguuacgcuaccuagucauucgacaaggaaauuacaaacaagaagucaaacauggcuagaaagcagagaauacacuaaacaccuaauaagaguagaaaacuggauauuuagaaauccuggauuugcacuagcagcugcggcaauagcauggcuauugggcucaucaacaagccaaaaaguaauauaucuagucaugauacucuuaauagcaccagcauacagcuuaagauguauaggagucagcaaucgagauuuuguagaggguaugaguggagguacauggguggauguaguucuugaacauggaggguguguaacaguaauggcucaagauaaaccaacaguagauauagaguugguaacgacaacagucagcaauauggcagaaguaagaagcuacuguuacgaagcaucaauaucagauauggcaagugacucaagauguccaacacaaggagaagcauauuuagauaaacaauccgauacucaauauguauguaaacgaacguuaguagacagagguuggggaaauggauguggccuuuuuggaaaagguucacuaguaacuugugccaaauuugcauguucaaaaaaaaugacaggaaaaucaauacaaccagaaaauuuagaauauagaaucaugcuuucaguccauggaagucagcacucaggaaugaucgucaaugauacaggacaugaaacugaugaaaauagagcuaaaguugaaauuacaccgaauuccccaagggcugaagcaacucuuggcggauuugguagucugggucuagacugcgaaccaagaacagguuuagacuuuucagauuuauacuaccuaacaaugaauaauaaacauugguuagugcauaaagaaugguuucacgauauuccauuaccauggcacgcaggugcagauacagguacaccacauuggaauaauaaagaggcacuaguagaauuuaaagaugcacacgcaaaaagacaaacaguaguaguauuagguucacaagaaggagcaguacauacagcuuuagcaggagcauuagaagccgaaauggacggcgccaaaggaagacuuucaagcgggcauuuaaaaugcagauuaaaaauggauaaacuuaggcuaaaaggaguaaguuauaguuuauguacagccgcuuucacauuuacuaaaauaccagcagaaacacuacacgguacaguuacuguugaaguucaauacgcagguacagauggucccuguaaaguaccagcacaaauggcuguagacaugcaaacgcuuaccccaguaggaagauuaauuacugcaaacccaguaauaacagaaucaacagagaacagcaaaaugauguuagaauuagauccaccuuucggugauucauauauaguaauaggaguaggagaaaaaaaaauaacacaucauuggcauagaagugggaguacaauugguaaagcguucgaagcuacuguuagaggagcaaaacgaauggcgguauuaggagauacagccugggauuucggaaguguugguggagcauuaaauaguuuaggcaaaggaauacaucaaauauucggagcugcauuuaagagucuauucggugguaugaguugguucucacaaauacuaauuggaacacuauuaaugugguuaggauuaaauacaaaaaacggaaguauaucacuaauguguuuagcauuagguggaguuuuaauuuuucuaagcacagcaguaucagcu

SEQ ID NO: 2656 - RNA, 2061 nt, Artificial Sequence
  KY075932.1 prME-short CDS opt
acgaguguuggcauuguaggguuauuauuaacaacggcuauggcagcagaaguaacaagaagaggaucagcauauuauauguauuuagauagaaacgacgcaggagaagcaauaucuuucccaacaacacuagguaugaauaaauguuauauacaaauaauggaucuaggucauaugugugaugcuacaaugagcuaugaaugcccaaugcuagaugaaggaguagaaccggaugacguagacuguugguguaauacaacaucuacauggguaguauacggaacaugucaccauaagaaaggagaagcaagaagaucgcguagagcagucacacuccccucacauucaaccagaaaauuacaaacuagaagucaaacuugguuagaaucaagagaauauacuaaacacuuaauaagaauagaaaacuggauauucagaaauccaggauuugcauuagcugcggcagcuauagcauggcucuuaggaucuucuaccagucaaaaaguaauauaccuaguaaugauacucuuaauagcaccagcauauucuauacgaugcauuggagugaguaacagagauuuuguugaaggaaugucaggaggaacauggguagacguuguucucgaacacggaggauguguaaccgugauggcucaggauaaaccaacaguagauauugaauuaguaacaacaacaguuucaaauauggcagaaguccgaaguuacuguuacgaagcauccauaucagacauggcaucggauucaagauguccaacccaaggagaagccuauuuagauaaacagucagacacucaauauguuuguaaacgaaccuuaguagaucgaggcugggguaauggauguggacuuuucgguaaaggcagucuuguaaccugcgcaaaauucgcauguaguaagaaaaugacaggaaaaaguauccaaccagaaaaccuggaauauagaauuaugcuaucaguccacggaucacaacauucaggaaugauaguaaaugauacuggucaugaaacagaugaaaauagggcaaaaguagaaauaacuccaaauucaccacgagccgaggccacccuuggaggauuuggaucauuaggccuagauugcgaaccuagaacaggauuagauuuuagugauuuauacuauuuaaccaugaacaacaaacauugguuaguucauaaagaaugguuucaugauauaccauuaccauggcaugcuggagcagauacagguacaccacauuggaacaauaaagaagcauuaguugaauuuaaagaugcacacgcuaaacgucaaacuguuguuguuuuaggaucacaggaaggagcuguacauacagcauuagcgggugccuuagaagcagaaauggacggagcaaaaggucgacuaaguaguggucacuuaaaauguagauuaaaaauggacaaauuaagauuaaaagguguuuccuauuccuuauguacagcagcguuuaccuucaccaaaauaccagcagaaacccuacacggaacaguaacaguagaaguacaauaugcagguacagauggacccuguaaaguuccugcacaaauggcaguagacaugcaaacuuuaaccccaguaggaagauuaauaacagccaauccagugauuacagaauccacagaaaacucgaaaaugauguuagaauuggauccaccauucggugauaguuacauaguuauaggaguaggagaaaagaaaauuacacaccauuggcacagaagcggaagcacaauaggaaaagcauucgaagcaacaguaagaggagcaaaaagaauggcugucuuaggagauacagcaugggauuucgguucuguuggcggagcuuugaacaguuugggcaaaggaauacaucaaauauuuggggcagcauuuaagagcuuauuuggagguaugucaugguucucacaaauauuaauaggaacauuacuaauguggcuaggauuaaauacgaaaaauggcagcauuucacuaaugugucuagcauuagguggagucuuaauauuucuaucaacagcaguaucagcu

SEQ ID NO: 2657 - RNA, 2061 nt, Artificial Sequence
  KU870645.1 prME-short CDS opt
acaucagugggaauugugggauuauuauuaacaaccgcuauggcagcagaagucacuagaagaggaucugcauauuacauguaucuagauagaaacgaugcaggagaagcaauaaguuucccaacaacauuagguaugaauaaauguuacauacagauaauggaucuaggucauaugugcgaugcaacuaugaguuaugaaugcccaauguuagaugaaggaguagaaccagaugauguagauuguugguguaacacaacaucaacauggguagucuacggaacaugucaucauaagaaaggugaagcuagaagaagccgcagggcaguaacuuuaccgucgcacucaacaagaaaacuucagacaagaagucaaacuugguuagaaaguagagaauauacaaaacauuuaauccguguagaaaauuggauauuaaggaacccaggauucgcauuagcagcagcggcaauagccugguuacuagguucaagcacgucacaaaaaguaauauacuuagucaugauacuguuaauugcaccagcauauagcauucguuguauuggcguaucuaacagagauuucguugaaggaaugucgggaggaacauggguugauguaguucuagaacauggcgguuguguaacaguaauggcccaagauaaaccaacaguagauaucgaacucguaacuacaacgguauccaauauggcagaaguucgaaguuauuguuacgaagcaaguauaagugacauggccuccgauucaagauguccuacgcagggugaggcuuaucuagacaaacaaucggacacacaauauguauguaaaagaacauuaguagauagaggauggggaaauggauguggacuauuuggaaaaggaaguuuaguaaccugugcaaaauuugcuugcaguaagaaaaugacagguaaaagcauacaaccagaaaaucuugaauauagaauaaugcugagcguacacggcagccaacacucuggaaugauuguaaacgauacugggcaugaaacagaugaaaaucgagcaaaaguagaaauaacaccaaacagcccaagggcugaagcaacccuggguggauuuggaaguuugggucuagauugcgaaccaagaaccggucuagauuucucagauuuauauuauuuaacgaugaauaauaaacauugguuaguacauaaagaaugguuccaugauauaccauuaccauggcaugcaggagcugauacaggaacaccacauuggaauaacaaagaagcauuaguagaguucaaagaugcacacgcaaaaagacaaacuguaguaguacuaggaagucaagaaggagcaguccacacagcauuagcaggagcucuagaagcagaaauggauggugcaaaaggccgacuaucuucuggacauuuaaaauguagauuaaaaauggacaaacuaagauuaaaaggagugucauacucauuaugcacagcagcauuuacauuuacaaaaauuccagcagaaacacuacauggaacaguaacuguagaaguccaauaugccggaacagacggaccuuguaaaguaccagcacaaauggccguagauaugcaaacauuaacaccuguagguagacuaauuacagccaauccaguaauaacugaauccacugaaaauagcaaaaugaugcuagaacuggauccuccauuuggagauucauauauagucauagggauaggagagaaaaagauaacacaccacuggcauagaucuggaaguacuauagguaaagcauucgaagcaacaguaagaggugcaaaaaggauggcaguauuaggagacacagccugggauuucggaucaguaggaggugcauuaaauucauuaggaaaagguauccaccaaauuuucggagcagcuuuuaaaucuuuauucgguggaaugaguugguuuucacaaauauuaauuggaacuuuacuaauguggcuaggauuaaauaccaaaaauggaucaauaagucuuaugugucuagcauuagguggaguacuuauauuucuaaguacagcaguaucagcu

SEQ ID NO: 2658 - RNA, 2061 nt, Artificial Sequence
  KU729217.2 prME-short CDS opt
acuucaguaggaaucgucggacuuuuguuaacaacggccauggcugcagagguaacaagaagaggaucagcuuauuacauguauuuagauaggaaugaugcuggagaagccauaaguuucccaacuacacuaggaaugaauaaauguuauauucaaauaauggauuuaggucauaugugugacgccacuaugaguuacgaguguccaauguuggaugaaggcguagaaccagacgauguugacuguuggugcaacaccacaucaacauggguaguauaugguacaugucaucauaagaaaggagaagcaagaagaucaagaagggcaguaacacucccuucacauucaacaagaaaauuacaaacgagaagccagacauggcuagagucaagagaauauacuaaacacuuaauaagaguagaaaauuggauauucagaaauccaggguuugcauuagcagcagcagcaauagcuugguuacuaggaaguaguacgucacaaaaaguaauauaucuuguaaugauuuuauuaauugcaccagcuuauagcauuagauguauaggcguuuccaaccgugauuuuguugaaggaaugucuggaggaacauggguugauguagugcuagaacacggaggauguguaacaguuauggcacaagauaaaccaacaguggacauagagcuaguaucaacuacugucagcaauauggcggaaguaagaucauacuguuacgaagccacaauaagugauauagcaucagacucaagaugcccaacacaaggagaagcauaucuagacaaacaaucagacacucaauauguauguaaaagaacauugguagauagaggauggggaaauggaugcggauuauuuggaaaaggcaguuuaguuacaugugcaaaauuugccugcaguaagaaaaugacuggaaaaucaauacaaccugaaaauuuagaauauagaauaauguuaucaguacaugggucucagcacucaggaaugauagucaaugacacaggacacgaaacugaugaaaauagagcuaaaguugaaauaacaccaaauagcccacgagcagaagcaacauuaggaggcuuuggaaguuuaggacuagauugugaaccaagaacaggccuagacuuuucagaucuauauuauuuaacaaugaacaacaaacauuggcuaguacacaaagaaugguuccacgauauaccauugccauggcacgcaggagcagacacaggaacuccacauuggaauaauaaagaagcucuuguagaauuuaaagaugcacaugcaaaaagacaaacagccguaguacuagguucacaagaaggagcuguacacacagcacuagcuggagcauuagaggcagaaauggauggagcuaaaggaagauugucgagugggcaucuaaaaugcagauuaaaaauggacaaauuacgauuaaaaggaguaucuuauucacuaugcaccgccgcauuuacauuuacaaaaauaccggcagaaaccuuacauggaaccguaacaguugaaguacaauaugcaggaacagaugguccauguaaaguaccagcucaaauggcaguugauaugcaaacauuaacaccagucggaagacuuauaacagcaaauccaguaauaacagaauccacagaaaauagcaaaaugaugcuggaacuagauccuccauuuggggacucauacaucguaauaggaguaggagaaaagaaaauaacgcaccauuggcauagaagugguaguacaauaggaaaagcauucgaagcuacaguaagaggagcgaaaagaauggcaguauuaggugacacugcuugggauuuuggaucagucggcggggcauuaaauucauuagguaaaggaauacaucagauuuuuggagcagccuuuaaaucauuauuuggugggaugaguugguuuucacaaauauuaauaggaaccuuacuuaugugguuaggcuuaaauacuaaaaaugguagcauaucacuuaugugcuuagcauuagguggagucuuaauauuuuuaucuacagcagucagcgcc

SEQ ID NO: 2659 - RNA, 2061 nt, Artificial Sequence
  KX087101.3 prME-short CDS opt
acaagcguagguauaguugguuuacuuuuaacaacagcaauggcagcagaaguaacuagaagaggaagugcauauuauauguaccuagaucguaacgacgcgggugaagcaaucagcuuucccaccacuuuaggaaugaauaaauguuacauacaaauaauggacuuaggacauaugugugaugcaacaaugaguuaugaauguccaaugcuagaugagggaguugaaccagaugaugucgacuguugguguaauacaacaaguacuuggguuguauaugggacuugucaucauaagaaaggugaagcuaggagaucaagacgcgcagugacacuaccuagucauagcacuagaaaacuccaaacacgaucacaaacaugguuagaaucacgcgaauacacaaaacacuugauacguguagaaaacuggauauuucguaacccagguuucgcacuggcagcagcagcaauagcauggcuauuaggaaguagcacuucacaaaaagucauauaucuagucaugaucuuauuaauagcaccagcauauaguauaagaugcauagggguaucaaacagagauuucguagaaggaaugaguggaggaacauggguagacguaguacuggaacacggaggaugcguaacuguaauggcacaagacaaaccuacaguagauauagaguuaguaacgacuacaguuaguaacauggcagaaguuagaaguuauuguuaugaagcaaguauaagugauauggcaagcgauaguagaugcccaacccaaggagaagcauauuuagauaaacagagcgacacucaauauguuuguaaaagaacuuuaguagacaggggaugggggaacggauguggacuauuuggaaaaggauccuugguuacaugugcaaaauuugcauguucaaagaaaaugacaggaaaaucaauccagccugaaaaccuugaauacagaaucaugcuaagcguacaugggucacaacacucaggaaugauaguaaacgauacgggacaugaaacagaugaaaacagagcaaaaguggaaauaaccccaaauagcccacgagcagaagcaacucuuggagguuuuggaucucuaggauuagauugugaaccccgaacuggucuagauuuuagugacuuauauuaucucacuaugaauaacaaacacugguuaguacauaaagaaugguuccaugauauaccacuacccuggcaugcuggagcagacacgggaacaccacauuggaauaauaaagaagcucuaguagaauuuaaagaugcacacgcaaaaagacagacaguagugguauuaggaucacaagaaggugcaguacauacagcacuugcaggagcccuagaagcagaaauggacggagcaaaaggccgacuaaguaguggacaucuaaaauguagauuaaaaauggacaaauuaagacuaaaaggaguaucuuauucauuauguacagcggcauuuacauuuacuaaaauacccgcugaaacacuacacggaaccguaacaguagaacuacaauaugcagguacagaugguccauguaaaguaccugcccaaauggcuguagauaugcaaacguuaacaccaguuggaagguuaauaaccgcaaacccaguaauaacagaaucaacggaaaacagcaaaaugauguuagaauuagacccaccauuuggugacucauauauaguaaucggaguaggagaaaagaaaauaacacaucacuggcauagaaguggaaguacuauaggaaaagcauuugaagcaacaguaagaggagcaaaaagaauggccguauuaggagauacugcuugggauuuugguucaguagguggagcacuaaacagucuaggaaaaggaauacaccaaauauuuggugcagcauuuaaaagucuauucggcggaaugucgugguuuucacaaauacuaauagguacacuauuaauguggcuuggacuuaauacuaaaaauggaagcaucagcuuaauguguuuagcauuaggaggcguccuaauauucuuaaguacagcaguaagugcu

SEQ ID NO: 2660 - RNA, 2061 nt, Artificial Sequence
  KY014317.1 prME-short CDS opt
acaagcguaggcauaguaggauuacuauuaacaacagcaauggcugcagaaguaacaaggcgaggaagugcauauuauauguauuuagauagaaaugacgcaggcgaagcaauaaguuuuccaacaacauuaggaaugaacaaauguuacauacaaauaauggauuuaggacauaugugugacgcaacaaugucauaugaauguccaauguuagaugaaggaguggaaccagaugauguagacuguuggugcaauacuacaaguacguggguaguauacggaacgugccaucauaaaaaaggagaagcccgaagaagccgaagagcuguaacucuacccagccauucuacccgcaaauuacaaaccagaucacaaaccugguuagaaucaagagaauauacaaaacacuuaauuagaguugagaauuggaucuuuagaaaucccgguuuugcauuagcagcagcggcaaucgcauggcuauuaggaucuucaacaucacaaaaaguaauauacuuaguaaugauauuauuaauagcuccagcauacaguauaagauguauaggaguaucaaauagagauuucguugaaggaaugucuggaggaacauggguagauguaguacuagaacacggcggauguguuacaguaauggcacaagauaaaccuacaguagauauagagcucgucacaacuaccguuucaaauauggcagaaguaaggucauauugcuacgaagcaagcaucagugauauggcaagcgauucaagauguccaacucaaggagaagcauaucuagacaaacaaucagacacacaauauguaugcaaaagaacacuuguagacaggggaugggguaaugggugcggccuauucgguaaagguucgcuaguaacaugcgcgaaauuugcaugcaguaaaaaaaugacagguaaaaguauucaaccagaaaacuuagaauauaggauaaugcuaucuguucauggaucacaacacagcggaaugauaguaaaugauacuggacacgaaacagaugaaaaccgagcaaaaguagaaauaacaccaaauagcccaagagcugaagcaacucuagguggauuugguucacuagguuuggacugugaaccaagaacaggacuggauuuuucagaucuauauuauuugaccaugaacaacaaacauuggcuuguacauaaagaaugguuccaugauaucccauuaccauggcaugcaggcgcggauacaggaacaccacauuggaauaacaaagaagcacuaguggaguucaaagacgcacacgcaaaaagacagacaguaguaguacuaggaucacaagaaggagcaguucauacagcuuuagccggcgcuuuggaagcagaaauggauggagcaaaagguagacuuaguuccggccaucuuaaaugucgacugaaaauggauaaacuacgacuaaaaggagugucauauucacucuguacagcagcauuuacuuucacuaaaauaccagcagaaacauuacauggaacuguaacaguagagguacaauaugcuggcacagacggcccauguaaaguaccagcacaaauggcugucgauaugcagaccuuaacuccuguugguagacuaauaaccgcaaauccaguaauuacagaaaguauagaaaauagcaaaaugaugcuugaacuagauccaccauuuggugauucguauauaguuauagggguuggagaaaaaaaaauaacucaucauuggcauagaucaggaucaacuauaggaaaagcauuugaagcuacaguaagaggagcaaaaaggauggcaguuuuaggugacacagcaugggauuuugguucuguaggaggagcauuaaacucccuagguaaaggaauacaucaaauauuuggugcagccuuuaaaagccuauuuggagguaugucuugguuuucacaaauauuaauaggaacacuucuaauguggcuaggacuaaacacuaagaauggaaguaucagcuuaauguguuuagcacucggaggaguacuaauauuuuuaucaacagcaguguccgca

SEQ ID NO: 2661 - RNA, 2061 nt, Artificial Sequence
  KU758876.1 prME-short CDS opt
acaucaguuggaauaguaggucuauuacuaacaacagcaauggcugcagaaguaacucggcguggaagcgcuuauuacauguacuuagacagaaaugaugcaggcgaagcaauaucauuuccaacaacacuaggcaugaauaaaugcuacauacaaauaauggauuuagggcauaugugugaugcaacuaugucuuacgaauguccaauguuagaugaaggcguagaaccagaugauguagauuguuggugcaauacaacuucaacauggguaguauacgguacaugucaucacaagaaaggagaagcuagaagaucaaggagagcgguaacacuaccuagucauaguacaagaaaacuacaaacucgaucacaaaccugguuagaaucacgugaauacacaaaacauuuaauaaggguagaaaauuggauauucagaaauccagguuuugcacuggcagcagcugcaauagcauggcuuuuaggaucaagcacaagucaaaaagucauauaccuggugaugauauuauuaauagcuccagcuuauaguauacgauguauaggaguaaguaauagagauuucguagaaggaaugucaggagguacaugggucgaugucguucuagaacauggaggaugugucacgguaauggcacaagacaaaccaacaguagauauugaauugguaacuacaacuguaagcaacauggcagaaguaagaucauauuguuacgaagcaucuauaagugacauggcaucagauucacgaugcccaacacaaggugaagcauauuuagauaaacaaucugacacucaauauguauguaaaagaacucuaguagaucgaggauggggaaaugguugugggcuauuuggaaaaggaagccuaguaacaugcgcaaaauuugccuguucaaagaaaaugacaggaaaaucaauccaaccagaaaaccucgaauauagaauaaugcuaucaguacacggaucacaacacagcggaaugauaguaaaugacacaggacaugaaacagacgaaaacagagcaaaaguagaaauaacacccaauagccccagagcugaagcaacauuaggaggauucggaaguuuaggacuugacugugaaccaagaacaggauuagacuucagcgaccuauauuauuuaacaaugaauaacaaacauuggcuaguacacaaagaaugguuucacgauauaccuuuaccauggcacgcaggcgcugacacugguacuccacacuggaauaacaaagaagcacuuguagaauuuaaagaugcgcaugcaaaaagacaaacaguagugguacuaggcucucaagaaggugcaguacauacagcacuagcaggcgcauuagaagccgaaauggauggcguaaaaggaagacuaucaucggggcauuuaaaaugucgucuaaaaauggacaaauuaagacuaaaaggaguaucguauucauuaugcaccgcagcauucacauuuacaaaaauaccagcagaaacauuacauggaacaguaacaguagaaguacaauaugcagguacagacggaccauguaaaguuccagcacaaauggcaguggacaugcaaacauuaacaccgguaggaagauuaauaacugcaaauccaguuaucacggaaaguacagaaaauuccaaaaugauguuagaguuagacccuccauuuggagauaguuauauaguuauugguguuggggaaaagaaaauaacucaucacuggcauagaucaggcaguacgauaggaaaagcauuugaagcuacaguacgaggcgccaaaagaauggcaguauuaggagauacagcaugggacuuugguagcguagguggagcccuaaauucauugggcaaagguauucaucaaauauuuggagcugcauuuaaaagccucuucgguggaaugaguugguuuucucaaauacuaauaggaacauuauuaaugugguuaggacuaaauacuaaaaaugguucuauuagcuuuauguguuuggcacuaggaggagucuugauauuucuaaguaccgcaguaucagca

SEQ ID NO: 2662 - RNA, 2061 nt, Artificial Sequence
  KU758874.1 prME-short CDS opt
acaucuguugguaucguaggauuauuacucacaacagcaauggcggccgaaguaacuagaaggggaucagcauauuauauguaucuagauagaaacgaugcaggagaagccauaaguuuuccgacaacauuaggcaugaacaaaugcuauauacaaauaauggauuuagggcauaugugugaugcaaccaugagcuaugaaugcccaauguuagacgaaggaguagaaccagacgacguagauuguugguguaacacgacaaguacaugggucguauacggaacuugucaucauaaaaaaggagaagcuaggcguucaagaagagcaguaacauuaccaucacauucaacacgaaaacuucaaacaagaucacaaacauggcuagaaucaagagaauauacuaaacauuuaauaaggguugaaaacuggauauuuagaaacccaggauuugcccuagcugcagcagcaaucgcauggcuacuaggaucaaguacaagccaaaaaguaauauaucuaguaaugauacuauuaauagcuccagcauacucgauuagaugcauagguguaucaaauagagacuucguagaaggaauguccggaggaacauggguagacguaguguuagaacauggaggauguguuacaguaauggcacaggacaaaccaaccguugacauagaauuaguuacaacaacaguuaguaacauggcugagguacguucauauuguuaugaagcaucaauaucagacauggcaucagauucacgaugucccacucaaggugaagcauacuuagauaaacaaagcgacacacaauacguuuguaaacgaacacuaguagauagaggaugggggaauggauguggccuauuuggaaaaggaagccuaguaacaugugcuaaauuugcauguaguaaaaaaaugacaggaaaaagcauucaaccggaaaacuuagaauauagaauuauguuaucaguacaugguucacaacauucagggaugauaguaaaugauaccggacaugaaacugacgaaaacagagcaaaaguagaaauaacuccuaauaguccaagagcagaagccacauuagggggauuugggagucuaggacuagauugcgaaccuagaacaggauuagauuuuucagaucuauauuauuuaacaaugaacaauaaacacuggcuuguucauaaagaaugguuucacgacauaccacuaccauggcaugcaggagcagauacaggaacaccacauuggaacaauaaagaagcauuaguggaauuuaaagaugcacaugcaaaaaggcaaacugucguaguucuagguucccaagaaggugcuguacauacugcacuagcaggggcacucgaagcagaaauggacggagcuaaaggaaaacuaaguucagggcaccuaaaaugcagauuaaaaauggauaaauuacguuuaaaaggaguaucauauucauugugcacagcagcauuuacauuuacaaaaauuccggccgaaacguuacauggcaccguuacgguagaaguacaauacgcaggaacagaugggccauguaaaguaccugcccaaauggcaguugauaugcaaacacugacaccgguugggagacuaauuacugcuaacccaguaauaacugaaucaacagaaaauucaaaaaugauguuagaauuagauccaccauucggcgauagcuauauuguaauaggaguaggugaaaaaaaaauaacacaccauuggcacaggagcgguaguacaaucggcaaagcauuugaagcaacuguuagaggagcuaaaagaauggcaguguugggcgauacagcaugggauuuugggaguguaggaggggcacucaacucauuaggaaaagguauacaucaaauauucggagcagcuuuuaaaucauuauucggaggaaugagcugguuuagucaaauacuuauaggaacacuauuaaugugguuaggauuaaauacaaagaacggaagcauaucauuaauguguuuagcacuuggaggaguuuuaauauuucuaaguacagcugucagugcg

SEQ ID NO: 2663 - RNA, 2061 nt, Artificial Sequence
  KY317939.1 prME-short CDS opt
acaagcguaggaauuguaggacuacuguuaacaacagcaauggccgccgaaguaacaagaagaggcagcgcauauuauauguacuuagauagaaaagaugcuggagaagcaaucuccuuuccaacaacauuagguaugaauaaauguuauauacaaauaauggaucuaggacauaugugugacgcaacaaugucuuaugaauguccaauguuagaugaaggaguagaacccgaugauguagacugcugguguaauacgacaucaacuugggugguauacggaacaugccaccauaaaaaaggagaagcaaggagaucacguagagcaguuacacuuccuucucauucaacuagaaaauuacaaacacgaagccaaacuugguuagaaagcagagaauauacaaaacauuuaauaagaguagaaaacuggauauucagaaauccaggauuugcacucgcagcagcagcaauagcauggcuauuggggucaagcacaucacaaaagguaauauacuuaguuaugauauuauuaauugcaccagccuauucuauaagauguauaggaguaucuaacagagauuuuguugaagguaugucaggcggaacauggguagaugugguucuugaacaugguggauguguaacaguaauggcacaagauaaaccaacaguagauauagaauuaguaacaacaacaguaaguaacauggcagagguaagaaguuauuguuaugaagcaaguaucucagauauggcaagcgacucuagaugcccaacacaaggagaagcauaucuagauaaacaaagugacacacaauauguauguaaaagaacacuaguagauagaggauggggaaauggauguggacuuuuuggaaaagguucguuaguuacuugcgcaaaauuugcauguucaaaaaaaaugacuggaaaaaguauacaaccagaaaacuuagaguauagaauaauguuaucaguacacgggucucaacauaguggaaugauuguuaaugacacuggacaugagacagaugaaaauagagcaaaaguagaaauaacuccaaacucaccccgugcagaagcgacauuaggaggauuugguucauuaggauuagauugugaacccaggacgggacuagauuuuagugaucuauauuaucuaacuaugaauaauaaacauugguuaguacauaaagaaugguuucacgacaucccauuaccauggcacgcaggagcagauacaggaacaccucauuggaauaauaaagaagcauuaguugaauuuaaagacgcucaugcaaaacgucaaaccguaguuguacuagguagccaagaaggagcaguacauacugcauuagcaggagcauuagaagcagaaauggauggcgcgaaagguagauuaagcaguggccauuuaaaauguagacucaaaauggauaaacucagauuaaaaggaguuucauauagucuauguacagcagcauuuacauuuacaaaaauaccagccgaaacacuccauggaaccguaacaguagaagugcaauacgcaggaacagauggaccgugcaaaguaccagcccaaauggcaguagauaugcaaacauuaacaccuguaggaagauuaauaacagcaaauccaguaauuacagagucaacagaaaacagcaaaaugauguuagaacuagaucccccauucggagauaguuauauuguaauagguguaggugaaaaaaagaucacacaucauuggcacagaucaggaucaacaauugggaaagcuuucgaagcaacagucagaggugcaaaacgaauggcaguacuaggagauacagcgugggacuucggaaguguagguggagcacuaaacucacuggggaaaggaauacaccaaauauucggagcagccuuuaaaucacuauuugggggcaugucuugguucucucaaauacuaauuggaaccuuauuaauguggcuaggacuaaacacuaaaaauggaagcaucaguuuaaugugucuagcacuuggagguguuuuaauauucuuaucgacagccguuuccgca

SEQ ID NO: 2664 - RNA, 2061 nt, Artificial Sequence
  KY014314.1 prME-short CDS opt
acaaguguaggaauuguaggacuauuauuaacaacagcuauggcugcagaaguaacaagaagaggcagugcauacuauauguauuuagauagaaaugacgcuggagaagcaauuagcuucccaacaacauugggaaugaauaaaugcuacauacaaauaauggauuuaggccauaugugugaugcaacaaugaguuaugaaugccccaugcuagacgaaggaguugaaccagaugauguagauugcugguguaauacaacuucaacauggguuguuuaugguacaugucaccauaaaaaaggagaagcaaggcguucaagacgagccguaacacucccuucgcacucaacucgaaaauuacaaacccgaagccaaacauggcuagaaucaagagaauauacaaaacaucugauaagagucgaaaacuggauauuuagaaauccaggauuugcacuagcagcagcagcaaucgcauggcugcuugggagcucaaccucucaaaaagugaucuaucuuguaaugauacuguugauagccccagcauacucaauaagauguauagguguaagcaauagagauuucguagaaggcaugucaggaggaacauggguugauguaguauuagaacacggagguugcguuacagugauggcacaagacaaaccaacaguagacauagaacuaguaacaaccacuguaaguaauauggcagaaguacgaucuuauuguuaugaagcuaguauuucagauauggcaucggauucaagguguccuacucaaggugaggcauaccuagacaagcaaucagacacucaauacguaugcaaaagaacacuaguugauagaggauggggaaauggauguggauuguucggaaaagguucauugguaacaugugcaaaauuugcgugcucuaaaaaaaugacagguaaaucuauacaaccggaaaacuuagaguauagaauaaugcuaaguguacauggcucucaacauucuggaaugauuguaaaugauacaggacaugaaacagaugaaaauagagcaaaaguagaaauaacgccaaauaguccacgagcggaagcaacacuaggaggauuugguaguuuaggauuagacugugaaccgagaacaggauuagauuucagcgaccuauauuauuuaacgaugaauaauaaacauugguuaguacauaaagaaugguuucaugacauuccccucccauggcacgcaggggcagacacagggacaccacauuggaacaauaaagaagcacuaguagaauuuaaagaagcacacgcaaaaagacaaacaguuguaguacuaggaagucaagaaggagcaguacauacagcacuagcaggagcuuuagaagcagaaauggauggagcaaagggaagacuaucuucuggacacuuaaaauguagauuaaaaauggauaaacugagacuaaaagguguaucauauucguuauguacagcagccuucacauuuacuaaaauaccagcagaaacucuacauggaacgguuacaguagaaguacaauaugccggaaccgauggcccgugcaaaguaccagcacaaauggcaguggauaugcaaacauuaaccccaguaggaagauuaauaacagcaaauccaguaauaacagaaucaacagaaaauagcaaaaugauguuagaauuagauccaccuuuuggagauagcuacauaguaauaggagucggagaaaaaaaaauaacucaccauuggcacagaagcggaucaacaauaggaaaagcauuugaggccacaguuagaggagcaaaaagaauggcaguacuaggagacacugccugggauuuuggaagcguuggaggggcauuaaauagucuugguaaagggauucaucaaauauucggggcagcauuuaaaucacuauuuggaggaaugaguugguucucacaaauauugauaggaacauugcuaaugugguuaggacuaaauacaaaaaauggcagcauaagccucaugugucuugcucuaggaggaguucuaauauuuuuaaguacugcaguaagugcu

SEQ ID NO: 2665 - RNA, 2061 nt, Artificial Sequence
  KX447517.1 prME-short CDS opt
acaaguguuggaauaguaggauuacuacuaacuacugcaauggcagcagaaguaacuagaagaggcucagcuuauuacauguauuuagacaggaacgaugccggcgaagcgauaaguuuuccuaccacacuaggaaugaacaaauguuacauacaaauaauggauuugggacauaugugugaugcuacgaugagcuaugaguguccaaugcuagacgaaggaguugaaccugaugacguagauuguugguguaacacaacaagcacauggguuguauauggaacaugucaucacaaaaaaggagaagcuagaagaucaagaagagcagucacauuaccaagucauagcacaagaaaacuacaaacaagaucacaaacaugguuagaaucaagagaauauacaaaacaccuuauaagaguugaaaauuggauuuuuagaaauccaggauuugcuuuagcagcugcagcaauagcaugguuacucgguucuucaacaagccaaaaaguaaucuaucuaguaaugauauugcuaauugccccagcguacucuauucgauguauuggcguaucaaacagagauuucgucgaaggaaugucaggaggcacauggguagacguuguacuagaacacggagggugcguaacaguaauggcacaggacaaacccacaguugauauagaauuaguaaccacaacgguaucaaacauggcggaaguuagaucuuauuguuaugaggcaaguauaagugauauggcaucagauaguagauguccaacccaaggugaagcauacuuagauaaacaaucagacacacaauacguauguaaaaggacacugguagacagaggauggggaaauggauguggauuauuugguaaaggaaguuuaguaacaugugcaaaauuugcauguucaaaaaaaaugacgggaaaaaguauacaaccagaaaauuuagaauauagaauuauguuaaguguucauggaagccaacauagcgguaugauagugaacgacacaggucacgaaacugaugaaaacagggcgaaaguagaaauaacaccaaauaguccgcgcgcagaagcagcuuuaggaggauucggaucacuggguuuagauugcgaaccaagaacagguuuagauuucagugacuuguacuaccuaacaaugaauaauaaacauugguuagugcacaaagagugguuucaugauauaccauugccauggcaugccggagcagauacaggcacgccacauuggaauaauaaagaggcguuaguugaguucaaagaugcacaugccaaacgacaaacaguaguaguauuaggaucacaagaaggggcaguucacacagcauuagcaggagcauuagaagcagaaauggacggagcuaaaggaagauuaagcucaggacaccuaaaauguagauuaaaaauggauaaguugcgauuaaaagguguaucuuacucacuuuguacagcagcuuucacauuuacaaaaauacccgccgaaacacuacacgguacaguaacaguagagguacaauaugccggaacagauggaccauguaaaguuccagcacagauggcaguagauaugcaaacauuaacaccugucggaagauuaauaaccgcaaauccagugauaaccgaaucuacugaaaauucaaaaaugauguuagaauuagacccuccauuuggagauucauacauaguuauaggaguaggagagaaaaaaauuacacaucauuggcauagauccgguucaacuauaggaaaagcauuugaagcuacaguaagaggcgcaaaacguauggcaguauuaggagacacggcaugggauuucggaucaguaggaggagcauuaaacucauuaggaaaaggaauacaccaaauuuucggugcggccuuuaaaucauuauuugguggaaugagcugguuuucgcaaacauuaauaggcacuuuacucaugugguugggacuuaauacaaaaaauggaagcauaucacucauguguuuagcacugggaggaguacuuauauuuuuauccacugcaguuucagca

SEQ ID NO: 2666 - RNA, 2061 nt, Artificial Sequence
  KU926310.1 prME-short CDS opt
acaaguguagguauuguaggacuuuuauuaacuacagcaauggcagcagagguuacuagaagaggaucugcguauuauauguaucuagacagaaaugacgcaggagaagcaauaucuuuuccuacgacauuaggaaugaauaaaugcuauauacaaauaauggauuuaggccacaugugcgaugcaaccaugucauaugaauguccaauguuagaugaaggaguugaaccagaugauguagauugcugguguaauacaacaucaaccuggguaguauauggaaccugucaccacaaaaaaggcgaagcaagaagaaguagaagagcaguaacauuaccaucacauagcacacgaaaacuucaaacacgaagccaaacauggcuugaaaguagagaauauacuaaacaucuaauaagaguagaaaacuggauauucagaaauccaggcuuugcauuagcagcagcugccauugcauggcuauuaggcaguucaacaucacaaaaaguaauuuauuuaguaaugauucuauuaauugcaccugcauauaguauaaggugcauaggaguuuccaauagagauuuuguagaaggaaugucaggagguacauggguagauguaguucuagaacauggugguuguguaacaguaauggcucaggauaaaccaacaguagauauagaacuaguaacgacaacaguaagcaacauggcagaaguuagaagcuauugcuacgaagcaaguauaucagauauggcaagcgauucacgauguccaacacaaggagaagcuuaccuugacaaacaaucugauacucaauauguaugcaaaaggacguuaguagaucgugguuggggaaaugguuguggcuuauucggaaaaggaagucuaguuacaugcgccaaauuugcauguaguaaaaagaugacagguaaaucaauacaaccagaaaauuuagaauaucgaaucauguuaucaguacaugguucacaacauucugguaugauuguaaaugacacaggacaugaaacagacgaaaauagagcaaaaguagaaaucacaccaaacucuccaagagcugaagcaacuuuaggaggguucggcucguuaggauuagauugugaaccaagaacgggacuagacuuuucagaucuauauuauuugacaaugaauaauaaacacuggcuaguucauaaagaaugguuucaugauauaccacuaccauggcaugccggagcagacacuggaaccccccauuggaauaacaaagaagcacuaguagaauuuaaagaugcucacgcgaaacgacaaacuguaguaguacuuggaucacaagaaggagcaguacacacagcauuagcaggagcuuuagaagcugagauggacggcgcuaaaggacgacuaaguucaggccauuuaaaaugcagauuaaaaauggauaaacuaagauuaaaaggaguuucauauucacuauguacagcagcuuuuacauuuaccaaaauaccugcagaaacauugcauggaacaguuacaguagaaguacaauacgcuggagcugauggaccuuguaaaguacccgcucaaauggcaguagauaugcagacauuaacaccagucggaagauuaauuacagccaauccaguaauuacagaaucaacggaaaauucaaaaaugauguuagagcuagacccgccauuuggagauucauauauugugaucgguguaggcgaaaaaaaaauuacacaccauuggcauagaucagguucuacaauaggcaaagcguuugaagcaacugugaggggcgcaaaaagaauggcaguauuaggagauacugcaugggauuucggaaguguaggaggagcacuaaacucccugggaaaagguauccaucaaauauuuggagcggcguucaaaucauuauucgguggaaugucaugguucucacaaauccucauaggaacuuuauuaaugugguuaggacuuaauacaaaaaauggcaguauaucauuaaugugccuagcacuaggaggagucuuaauauuuuuaaguacugcaguuucagca

SEQ ID NO: 2667 - RNA, 2061 nt, Artificial Sequence
  KU922923.1 prME-short CDS opt
acaucagugggaauaguagguuuacuacuaacaacagcaauggcagcagaaguaacaagaagaggaucugcauauuauauguauuuggauagaaacgaugcaggggaagcaaucaguuuuccuacaacguugggaaugaauaaauguuauauacaaauaauggaccuaggacauaugugugaugcuacaaugucguaugaaugcccgaugcuggaugaagggguagaaccagaugauguagacuguugguguaauacaaccaguacaugggugguauauggaacaugucaucauaaaaaaggugaggcucgacgaaguaggagagccguaacauuaccuucacauucaacaagaaaauuacaaacaaggucacaaacaugguuagaaaguagagaauauacaaaacaucuaauuagaguugaaaacuggauauuuagaaacccaggguucgcuuuggcagcagcagcaauagcaugguuauuaggaagcucaacaucucaaaaaguuauauaucuagucaugauauuacuuauagcauuagcuuauuccauacgauguaucggaguaucaaauagagauuucguagaaggaaugucaggaggaacauggguugacguaguguuagaacaugguggcuguguaacaguaauggcacaagauaagccaacaguagacauugaauuaguaacuacaacaguaaguaauauggcagaaguaagaucuuauuguuacgaagcaaguaucagcgauauggccuccgauucaagaugcccgacacaaggugaagcauauuuagauaaacaaagcgauacgcaauacguauguaaacguaccuugguagacagagguugggguaauggaugcggauuauuuggaaaaggcucacuuguuacgugugcaaaauucgcaugcucaaaaaaaaugacuggaaaauccauacaaccagaaaaucuagaauauagaaucaugcuauccguacauggaucccaacauucagguaugaucguaaaugauacagggcaugaaacagaugaaaauagagcgaaaguagaaauaaccccaaauaguccaagagcugaggcaacuuuaggaggauuuggaucacuaggcuuagacugcgaaccgaggacagguuuagauuuuagugaucuauauuaucuuacuaugaauaauaaacauugguugguacauaaagaaugguuucacgauauaccauuaccauggcaugcaggagcugauacaggaacaccacauuggaauaauaaagaagccuugguugaauuuaaagacgcacaugcaaaacgacaaacaguagugguauuaggaagucaagaaggggccgugcacacagcauuagcuggagcucuagaagcagaaauggauggagcaaaaggaagacuaucaucaggacaccuaaaaugccgguuaaaaauggacaaacuaagacuaaaaggggugaguuacucauuguguacugcagcauuuacauucacaaagauaccagcagaaaccuuacaugguacugucacaguagaaguacaauaugcaggaacagauggaccauguaaaguaccugcacaaauggcaguagacaugcagacauuaacaccaguagguagacuaauaacugcaaaucccguuauaaccgaaucaaccgaaaauaguaaaaugauguuagaauuagauccaccuuuuggggauucauauauagucauaggaguaggagaaaaaaaaaucacucaucauuggcacagaagcggaucaacaaucgggaaagcauucgaagccacaguuagaggagcaaaaagaauggcagucuuaggagauacggccugggauuuuggaaguguagggggggcauuaaauucauugggaaaaggaauacaucaaauauuuggagcagcauuuaaaaguuuguucgguggaaugucaugguuuucucaaauacuaauaggaacucuauuaauguggcuaggucuuaauacaaaaaaugggaguauaucauuaaugugccuagcauuagguggagucuugauauuccuaagcacagcaguaagcgca

SEQ ID NO: 2668 - RNA, 2061 nt, Artificial Sequence
  KY075937.1 prME-short CDS opt
acaaguguaggaauaguuggauuacucuuaacaacagcaauggcagcagaaguaacaagaagggguucagcauauuauauguaucuagaucgaaaugaugcaggagaagcaauaaguuuucccacaacuuugggaaugaacaaauguuauauacaaauaauggacuugggacauaugugugaugcuacuauguccuaugaauguccaauguuagacgaaggaguagaacccgacgauguugauugcuggugcaacacaacaaguacuuggguuguauacggaacaugccaucacaagaaaggagaagcaagaagaucaagacgagcaguaacuuuaccaagucauaguacaagaaaauuacaaacacgaucacagacauggcucgaaucaagggaauauacaaaacaucuaauuagaguagaaaauuggauauucagaaauccaggauuugcauuagcagcugcagcaaucgcauggcuuuuagguucaucgacuucacaaaaaguuauauauuuaguaaugauacuucuaauagcccccgcauauucaauucggugcauuggagucucgaaucgagacuuuguggaaggaaugucagguggaacauggguagauguagucuuagaacauggaggaugcguuacuguaauggcucaagauaaaccuacaguagauauagagcuaguaacaacuacaguaaguaauauggcagaaguaagaaguuauuguuaugaggcaaguauaucugauaugguaucagauucaagauguccaacacagggagaagcauaccuagauaaacagucagauacucaauauguuuguaaaagaacauuaguagaucgaggaugggguaauggcuguggauuauuuggaaaaggaucacuuguaacaugugcgaaauuugcauguucaaagaaaaugacaggcaaaucaauucaaccagaaaauuuagaauacagaauaaugcuaaguguacacgguucacaacauuccggcaugauaguaaacgacacuggacaugaaacugacgaaaauagagcaaaaguugaaauaacaccaaauaguccuagagcagaagcaacauuagguggauuuggaucauugggauuagauugugaacccagaacaggucuggauuuuucagauuuauauuaccuuaccaugaacaauaaacauuggcuagugcauaaagaaugguuccacgacauaccacuaccuuggcaugcaggagcagauacaggaacaccacauuggaauaauaaagaggcuuuaguugaauuuaaagacgcacaugcuaaaagacaaacaguaguaguauuaggaagucaagaaggagcaguacauacagcacuagcuggugcauuagaagcagaaauggacggugcaaaagguagauuaucaucaggacacuuaaaauguagauuaaaaauggauaaacuacgccuaaaagguguaucauauucucuauguacagcagcauuuacauucacaaaaauuccugcagaaacauuacaugguacaguaacaguagaaguacaguaugcaggaacggauggacccuguaaaguaccagcacaaauggcaguagauaugcaaacauuaacaccagucggaagauuaauuacugccaacccaguaauuacagaaaguacagaaaacagcaaaaugauguuagaacuagacccacccuuuggagacucuuauauaguaauagguguaggagaaaagaaaauaacacaucauuggcaucguagugguagcacaauaggaaaagcguucgaagcaacaguaagaggagcaaaaagaauggcuguauuaggugauacagcuugggauuucggauccguaggaggagcacucaacaguuuaggaaaagguauucaccaaaucuuuggagcagcauuuaaaaguuuauuuggaggaaugagcugguuuagucaaauauuaauugguacucuauuaaugugguuaggauuaaauacuaaaaauggaucaauaagucuaaugugccuagcauuaggcgguguacuaauauuucugucuacagcgguuucagcu

SEQ ID NO: 2669 - RNA, 2061 nt, Artificial Sequence
  KY003156.1 prME-short CDS opt
acaucaguugggauugugggucuucuuuuaacaacagcuauggcagcagaaguaacaagaagaggaucagcauacuacauguauuuagaucgaaaugaugcuggagaagcaauaaguuuuccaacuacuuuaggaaugaauaaauguuauauacaaauuauggauuuaggacauaugugugaugcuacuaugagcuaugaauguccaaugcuagaugaaggaguagaacccgacgauguagauugcugguguaacacuacaagcacguggguuguauauggaacuugccaccauaagaaaggagaagcuagaagaaguagacgagcaguaacacuaccuagucauucaacgagaaaacuacaaaccagaucacaaacauggcuagaaucaagagaauauacaaaacaccucauaagaguugaaaacuggauauuuaggaacccaggauuugcucuagcagcagcugcaaucgcaugguuauuaggauccucaacaucacaaaaaguuauauacuuaguaaugauuuuauuaauagcaccagcuuauuccauuagauguauagguauaagcaacagggacuuuguagaaggaaugaguggaggaacuugggucgauguagucuuagaacacggcggaugcguaacuguaauggcacaggauaaaccaacuguagauauagaauuaguaaccacaacuguaucuaauauggcugaaguaagaucauacugcuaugaagcaaguauaucugauauggcaucagacucaagaugcccaacacaaggagaagccuauuuagacaaacaaagugauacacaauacguauguaaaaggacauuaguagauagaggauggggaaauggcugcggauuauuugguaaaggaagucuaguaacuugugccaaauucgccuguucaaagaaaaugacaggaaaaucaauucaacccgaaaaucucgaauaucguauaauguugucaguacacggaucacaacauaguggaaugauaguuaacgacacuggccacgaaacggacgaaaaucgagcaaaaguagaaauaacaccaaauaguccuagagcagaagcgacauuaggaggauuuggcauauuaggauuagauugugaaccaagaacuggacucgauuuuucagauuuauacuauuugacaaugaauaauaaacacugguuaguacacaaagaaugguuucaugacauaccuuuaccguggcaugcaggagcagacacaggaacgccucacuggaacaauaaagaagcauuaguggaguucaaagaugcacacgcaaaaagacaaacaguaguaguauuagguagucaagaaggagcaguacauaccgcacuagcuggcgcuuuagaagcagaaauggauggcgcaaaaggaagauuaucaagcggacauuuaaaauguaggcuaaaaauggauaaacuaagauuaaaaggaguaagcuauagcuuaugcacagcagcauucacauuuacaaaaauaccagcagagacauuacaugguacaguuacuguagaaguccaauaugcagguacugauggaccauguaaaguaccggcacaaauggcaguagacaugcaaacauuaacaccuguugguagacuaaucacagcaaauccuguaauaacagaaucaacagaaaacucgaaaaugauguuagaauuggacccuccauuuggagacucauauauugucauaggaguaggagaaaagaaaauaacucaucauuggcauagaucaggaucaacaauaggaaaagcauuugaagcaacagugagaggagccaaaagaauggcgguucuuggagacacagcuugggauuuuggaucuguaggaggagcauuaaauaguuuaggaaaaggaauacaucaaauauuuggcgccgcuuuuaaaagccuuuuuggaggaaugucaugguuuagucaaauacugauagguacgcuauuaauguggcuugguuugaauacgaaaaauggaaguauaaguuuaaugugucuggcacuuggagggguauuaauauucuuaucaacagcagugucagca

SEQ ID NO: 2670 - RNA, 2061 nt, Artificial Sequence
  KU312313.1 prME-short CDS opt
accaguguagggauaguaggauuacuauuaacuaccgcaauggccgccgaaguaacaagaagaggcagugcauauuacauguacuuagacaggaaugacgccggugaagcuauaaguuuuccaacaacuuuaggaaugaauaagugcuauauucaaauaauggacuuaggacauacgugugaugcaacaaugucauaugaauguccgauguuggacgaaggaguagaaccagaugauguagauuguugguguaacacaacgaguacauggguuguauauggaacuugucaucacaagaaaggagaagcaagaagaagcagacgagcaguaacccuucccucucacaguauaagaaaacuacaaacaaggagccaaacauggcuagaaaguagagaauauacaaaacaucugauuagaguugaaaauuggauauucagaaauccuggauuugcguuagcagcggcagcaauagcaugguuauuagguaguucaacaagucaaaaaguaauuuaccuaguaaugauauuacuaauugcaccagcauacucuauaaggugcaucggaguaucaaauagagauuucguagaagguaugucaggaggaacauggguagacguaguguuagaacaugguggauguguaacuguaauggcgcaagauaaaccaacaguggauauagaacugguaacaacuacuguaagcaauauggcagaaguacgaucguauuguuaugaggccaguauaucugauauggccagugacaguagaugcccaacacaaggugaagcauaccuagacaaacaaucagacacucaguauguuuguaaacgaacauuaguagaucgagguugggguaauggauguggguuauucggaaaaggaaguuuaguaacuugugcaaaauuugcauguucaaagaaaaugacaggaaaaucaauacaaccagaaaaucuagaauauagaauaauguuaucuguacaugguagccaacacagcggaaugauuguuaacgacacaggacaugaaacggaugaaaauagagcgaaaguugaaauaaccccaaauagcccaagagcagaagcaacuuuagguggauuuggaucauuagguuuagauugugaaccaagaaccggacuagacuuuagugaccuauauuauuuaacaaugaauaauaaacauugguuaguacauaaagaaugguuucacgauauaccacucccauggcacgccggagcagauacagguacaccacacuggaauaauaaagaagcauuaguagaguucaaagaugcgcacgcaaaaagacaaacuguugugguucuaggaagucaagaaggcgcaguucauacugcauuagcgggagcacuagaggccgaaauggacggagcaaaaggaagacuuagcucaggucaucuaaaaugcagauuaaaaauggauaaacuccgauuaaaaggaguaucauacaguuuauguacagcagcauuuacauuuacaaaaauaccagcagaaacucuacauggaacugugacaguagaaguacaauacgcggguacugacggaccuuguaaaguaccagcucaaauggccguggauaugcaaacauuaacaccaguuggaagauuaauuacagcuaacccaguaauaacugaaucaacagaaaacagcaaaaugauguuagaauuagacccgccauuuggagacaguuauauaguaauuggaguaggcgaaaagaaaauaacucaucacuggcaccgaucaggaucaacaauagguaaagcauuugaagcaacuguucgaggagcaaaaaggauggcaguacuaggcgauacagcgugggauuuuggaucuguaggaggugccuuaaauucuuuaggaaaagguauacaccaaauuuuuggagcagcauuuaaaucacuauuugguggaaugagcugguucucacaaauauuaauaggaacacuauuaauguggcuuggucuaaaugcuaaaaaugguaguauaaguuuaauguguuuagcauuaggaggaguacuaaucuuccuaagcaccgcaguaucagca

SEQ ID NO: 2671 - RNA, 2061 nt, Artificial Sequence
  KY075935.1 prME-short CDS opt
acauccguagguauaguaggauuacuacuaacaacagccauggccgcagaaguaacccgucgaggaucugcauacuauauguauuuagaccgaaacgacgcaggagaagcuauauccuucccaacaacucuaggaaugaauaaauguuauauucaaauaauggauuuaggacauaugugcgaugcaaccaugucauaugaauguccaauguuagaugaagggguagaaccagaugauguagacugcugguguaauacaacuuccacauggguuguauacggaacgugucaucauaagaaaggagaagcgcaaagaaguagacgagcaguuacacuaccaagucauaguacaagaaaauuacaaaccagaucucaaacauggcuagaaucaagggaauacacuaaacaucuaauaagaguagaaaauuggauuuuuagaaauccuggauuugcacuagcggcagccgcaauagcauggcuauuaggaaguucuacaucacaaaaaguaauauacuuaguaaugauacuauuaauagcaccagcuuacaguaucagaugcauaggaguuucaaacagagauuucguagaaggcaugaguggaggaacauggguugauguaguacuagaacaugguggaugcguaacaguaauggcacaagacaaaccaacaguagauauugaauuaguaacaacaaccguaucaaauauggcugaagucagaaguuacuguuaugaagcuagcauaagugauauggcaagugauucaaggugcccaacacaaggugaggcuuaucuagacaaacaaagugacacacaauauguauguaaaagaacuuuaguagaccgaggauggggaaauggauguggauuauucggaaaaggauccuuaguaacuugcgcuaaauuugcguguucaaagaaaaugacagguaaaaguauacaaccagaaaauuuagaauauagaauaaugcuaucaguacacggaagccaacauucaggcaugauaguaaacgauaccggacaugaaaccgacgaaaacagagcaaaaguugaaauuacacccaacagcccccgagcagaagcaacccuuggagguuuuggcagcuuaggauuagauugugaaccaagaaccggauuagauuuuagugaccuauauuaucuaacaaugaauaauaaacauugguuaguacacaaagaaugguuucacgacauaccauuaccauggcaugcaggagcagacacuggaacaccacauuggaauaauaaagaagcauuaguagaauuuaaagaugcucaugcaaaacgacaaacaguaguaguauuaggcagucaagaaggggccguacauacagccuuagcaggggcacucgaagcagaaauggacggagcuaaaggaagacuaucaaguggucauuuaaaaugucgcuuaaagauggauaaauugagauuaaaaggaguaaguuauucacuauguacagcugcauuuacauucacaaaaauaccagcagaaacacuucauggaaccguaacaguagaaguacaauaugcagggacagauggaccauguaaaguaccugcacaaauggcaguugauaugcaaaccuuaacaccaguaggaagacuaauaacagcaaauccaguaauaacagaaucgacagaaaauaguaaaaugauguuagaauuagacccacccuuuggagacucauauauagugauagguguaggugaaaagaaaauaacucaccauuggcauagauccggaaguacaauaggaaaagcauuugaagcaacaguaagaggagcgaaacguauggcuguacuaggagauacagcaugggauuuuggaucaguaggaggagcacuaaauagccuuggaaaaggaauacaccagauauuuggagcagcauuuaaaucuuuauuuggaggaaugucaugguucagucaaauauuaauagguacauuacuaaugugguuagguuuaaacacuaaaaauggaucuauaucuuuaauguguuuagcauuagggggaguuuuaauauuucuaucaacagcuguaagugca

SEQ ID NO: 2672 - RNA, 2061 nt, Artificial Sequence
  KY014320.1 prME-short CDS opt
acuuccguagguauaguagguuuacuauuaacaacugccauggccgcagaaguaacuagaagagguagcgcauauuauauguacuuagaucgaaacgaugccggagaagcaauaucauucccaacaacauuaggcaugaauaaauguuauauacaaauaauggauuuaggacauaugugugaugcaacaaugucauacgaauguccgaugcuagacgaagguguagaaccagacgauguagacuguugguguaacacaacuuccacauggguuguuuauggaacuugucaucauaaaaaaggagaagcaagacguucacguagagcuguaacccuaccaucacauucaacaagaaaacuucaagcaagaucacaaacauggcuagagucuagagaauacacaaaacauuuaauaagaguagaaaacuggauauuuagaaauccgggauucgcuuuagcugcagcagcaaucgccuggcuauuagguucaagcacaagucaaaaaguaauauacuuagucaugauauuauugauagccccagcuuauucaauaagauguauaggaguuucaaacagggauuuugucgaaggaaugucaggaggaacauggguagaugucguauuagaacacggaggauguguaacaguaauggcacaagauaaaccaacaguugacaucgaauuaguuacaacgacaguaagcaauauggcugaaguaagaucuuauuguuaugaagcaagcauuagugacauggcaagugauucaaggugcccaacacaaggagaagcuuauuuagacaaacaauccgauacucaauacguauguaaaagaacauuaguggauagaggauggggcaauggauguggccuauuugguaaaggaaguuuaguaacuugugcaaaauuugcauguaguaaaaaaaugacagguaagagcauacaaccagaaaaucuagaauaucgaauaauguuaucuguucauggcagucaacacucaggaaugauaguaaaugacacaggacaugaaacugaugagaauagagcaaagguagaaauaacaccaaacagcccaagagcugaagcaacauuaggaggguuuggaucauuaggacucgauugugaaccaaggacuggcuuagacuuuucagauuuauauuauuuaacaaugaauaauaaacauuggcuaguacacaaagaaugguuucaugauauuccgcuaccauggcacgcaggagcagauacgggaacuccccauuggaauaauaaagaagccuuaguagaguucaaagacgcacacgcaaaaagacaaacagucguaguacuuggaagucaagaaggagcaguacauacagcuuuagcaggggcucuugaagcagagauggacggagcaaaaggaagacugucaagcggacaucuaaaaugcagauuaaaaauggauaaacuaagauuaaaaggaguaucuuacagucuuugcaccgcugcuuuuaccuuuacaaaaauaccagcagaaacuuuacauggaacuguuaccguagaaguccaguacgcuggaacagauggcccaugcaaaguacccgcacagauggcuguagauaugcaaacauuaacaccaguagguaggcugauaacagcaaaucccguaauaacagaaucaacagaaaauucaaaaaugaugcuagaacuugacccaccuuuuggcgauaguuauauaguuauaggaguaggagaaaaaaaaauaacacaucauuggcacagaucugguuccacgaucggaaaagccuuugaagcaacaguaaggggagcgaaaagaauggcuguacuaggugacacagccugggauuucggaucaguuggaggugcacuaaauucauuaggaaaaggaauacaccaaauuuuuggagcagcauuuaaaucauuauucggcggaaugagcugguuuucacagauuuuaauaggaacacuauuaauguggcuaggacuaaauacaaaaaauggaucgauaagucuaaugugucuagcacuaggaggaguauugauauuucuaucaacggcaguuucagca

SEQ ID NO: 2673 - RNA, 2061 nt, Artificial Sequence
  KY328290.1 prME-short CDS opt
acaucaguaggcauaguaggacuauuacuaacaacagccauggcagcggaaguaacaaggagaggaucugcauauuacauguacuuagaucgauccgaugcaggagaagcaauaaguuuuccaacaacuuuagguaugaauaaauguuauauacaaauaauggauuuaggacacaugugugaugcuacuaugucuuaugaaugcccaauguuagacgaaggaguggaaccugaugauguugauuguugguguaauacaacaaguacauggguaguauaugguacaugucaucauaagaaaggagaagcgaggagaucaaggagagcuguaacauuaccaagucauagcacaagaaaauuacaaacaagaagccaaacuugguuagaaaguagagaauacacaaagcauuuaauaagaguagaaaauuggauauuuagaaacccaggauuugcacuagcagcagcagcaauagcauggcuauuaggcaguaguaccucacaaaaagucauauauuuaguuaugauacuuuuaauagccccugcauauagcauuagauguauaggcguuagcaaucgagauuuuguagaagguaugucaggagguacuuggguagauguaguauuagaacacgggggaugugucaccguaauggcccaagacaaaccaacuguagauauagaguuaguuacuacaacaguaagcaauauggcagaagucagaaguuauugcuacgaagcaagcauaagcgauauggcuagugauagccgauguccuacccaaggagaggcguauuuagauaaacaaucugacacgcaauauguauguaaaagaacucuaguagacagaggauggggcaacggaugcggauuauuuggaaaagguagcuuaguaacaugugcaaaauuugcauguucaaagaaaaugacuggaaaaaguauucaaccagaaaacuuagaauaucgaauaaugcuaucaguacauggaagucaacauucaggaaugauaguaaacgacacuggacacgagacagaugaaaaucgagcgaaaguagaaauaacaccaaauucaccuagagcugaagcaacauuagguggauuugguagcuuaggauuagauugugaaccaagaaccggucuagauuucagcgaccuauauuauuuaacaaugaauaauaaacacuggcuaguacauaaagaaugguuucaugauauuccucuaccuuggcacgcuggagccgacacuggaacaccucauuggaacaauaaagaagcguuagucgaguucaaagaugcccacgcaaaaagacaaacuguaguaguauuaggaucacaagaaggagcaguacauacagcacuagcaggagcacuagaagcagaaauggauggagcaaagggaagauuaagcaguggacaccuaaaauguagacuaaaaauggacaaacuaagauuaaaaggaguuucuuauagucuaugcacggcagcuuucacauuuaguaaaauuccagcugaaacauuacauggcacaguaacagaagaaguccaauaugcagguacugauggaccauguaaaguaccagcacaaauggcaguagauaugcagacacuaacacccguagguaggcuuauaacagcgaauccaguaauaacugaaaguacugaaaauaguaaaaugauguuagaauuagaucccccauuuggugauucauacauaguaauaggaguaggagaaaagaaaauuacacaucauuggcaccguucaggaucaacaaucggaaaagccuuugaagcaacuguuagaggagcaaaacgaauggcaguuuuaggagauacugcaugggauuucggaaguguaggaggggcauugaauagcuugggaaaagguauucaucaaauauucggagcagcauuuaaaagucuauuuggugguaugaguugguuuagucaaauacuaauuggaacauuacuaauguggcuagguuuaaauacgaaaaacggaucaaucaguuuaaugugccuagcucuaggcggcguccuaauauuuuugaguacagcaguuuccgca

SEQ ID NO: 2674 - RNA, 2061 nt, Artificial Sequence
  KU681081.3 prME-short CDS opt
acaucuguaggaauaguaggacuacuacuaacuacagccauggcugcagagguaacaagaagaggaucagcauauuauauguauuuggauaggucagaugccggugaagcaauaaguuuuccuacuacauuaggaaugaacaaauguuauauacaaauaauggauuuaggacauaugugugaugcaacaaugaguuaugaaugcccgaugcuagaugaaggagucgaaccagaugaugucgauuguuggugcaacacaacaucaacguggguugucuauggaacaugucaccacaagaaaggugaagcuagaagaucaaggagagcaguuacauugcccagucauaguacaagaaaauuacaaacaagaagucaaacaugguuagaaaguagagaauauacuaaacaucuaauacguguggaaaauuggauauuuagaaauccaggauuugcgcuagcagcagcagcaauagcaugguuacuagguucuaguacaagucaaaaaguaauauaucuagugaugauauuauuaauugcacccgcauauaguauaaggugcauaggugucagcaauagagauuuuguggaaggaaugucuggaggaaccuggguugauguaguuuuagaacaugggggaugcguuacaguaauggcacaggauaaacccacaguugauaucgaauugguuacgacaacaguuaguaacauggcagaaguaagaucauacuguuaugaagcaaguauaucagauauggcaucagauucaagauguccaacccaaggagaagcauauuuagacaaacaaagugauacccaauacguauguaaacgaacucuuguagauagaggauggggaaacggauguggauuauuuggaaaagguagucuaguaacuugcgcaaaauuugcuuguucaaagaaaaugaccggaaaaucaauacaaccagaaaacuuagaauauagaauuaugcuaaguguacauggaucucagcacagcgggaugauaguuaacgacacaggucaugaaacagacgaaaauagagcaaaaguagaaauaacaccaaacaguccaagagcagaagcaacccuugguggauuugggaguuuaggucuggauugcgaaccgagaacaggauuagauuuuagugauuuauauuaucuaacaaugaauaauaaacauugguuaguacauaaagaaugguuccaugauauaccacuuccauggcauacgggagcagacaccggaaccccacauuggaacaauaaagaggcauuaguugaauuuaaagacgcacacgcaaaaagacaaacaguaguaguacugggcucccaagaaggagcaguacauacagcacuagcgggugcacucgaagcagaaauggauggagcgaaaggaagauuaagcaguggccaucuaaaauguagguugaaaauggacaaacuaagguuaaaaggaguaaguuacagccucuguacagcugcuuucaccuuuacaaaaauaccggcagaaacauuacacggaacaguaacaguagagguucaauaugcaggaacagauggaccauguaagguuccagcacaaauggcagucgauaugcaaacauuaacuccaguuggaagauuaauaacagcaaauccuguuauaacagaaggaacagaaaacucaaaaaugauguuagaacuagauccaccauuuggcgauaguuauaucguaauaggaguaggggaaaagaaaauaacucaucacuggcauagaagcggaucaaccauagguaaagcauuugaagcaacgguaaggggugcaaaaagaauggcaguauugggagacacagcuugggacuuuggaaguguaggagguguauuaaacagucuaggaaaaggaauacaucaaauauuuggagcagcauuuaaaaguuuauuuggaggaaugagcugguuuucacaaauauuaauaggaacauuacuuaugugguugggacuaaauacuaaaaauggaucgauaagccugauguguuuagcacuagguggaguuuuaaucuuccuaaguacagcaguaagugcc

SEQ ID NO: 2675 - RNA, 2061 nt, Artificial Sequence
  KX827309.1 prME-short CDS opt
acaucaguaggaauaguaggauuacuacuaaccacagcaauggcagcagagguaacaaggagaggaucagcauauuauauguauuuagaucgaucagacgcaggagaagcaauaaguuuuccaaccacgcuaggcaugaauaaauguuacauucaaauaauggacuuaggucauaugugugaugcaacaauguccuaugaauguccuauguuagaugaaggaguugaaccugaugauguugauuguugguguaacacaacaucaacuuggguaguauaugguacaugucaccauaaaaaaggagaagcuagacgaaguagaagagcuguaacacuaccaagccacucgacuagaaaacuacaaacaagaucacaaacaugguuagaaaguagagaauacacaaaacaucuuauacgaguagagaauuggauauuucgcaauccaggauuugcacuagcagcagcagcaauagcgugguuauuagguucaucuacaagccaaaaaguaauauauuuaguaaugauauuauuaauagcaccagcguauucaauaagauguauaggagucaguaauagggauuucguagaaggaaugucuggcggaacauggguagauguaguacuagaacauggaggaugcguaacaguaauggcucaagauaaaccaacuguugauauagaauuaguaacaacaacaguaagcaauauggcagaaguaagaucauacuguuaugaggcaaguauaagugauauggcaucagauagcagaugucccacacaaggcgaagcauaucucgacaaacaaagcgacacgcaauauguauguaaacgaacucuaguagauagagguugggguaacggcuguggacuauuuggaaaaggaaguuuaguaaccugcgcuaaauucgcauguucaaaaaaaaugacgggaaaaucaauacaaccagaaaacuuagaauauagaauaauguuaagcguacauggcagucaacacucaggaaugauaguaaaugauacaggucaugagacugacgaaaaccgagccaaaguagaaauaacuccaaauucaccaagagcugaagcaacacuuggagguuuuggcaguuuagguuuagacugugaaccaagaacaggacuagacuuuuccgaucuauauuaccuaacaaugaacaauaaacauugguuaguacauaaagaaugguuucaugacauaccauuaccuuggcaugcaggagcagauaccggaacaccucacuggaauaauaaagaagcacuaguugaauucaaagaugcacaugcuaaaagacaaacugucguuguacuagguagucaagaaggagcaguucauaccgcacuagcgggagcacuugaagcagaaauggacggggcaaaaggaagauuaagcucaggacauuuaaaaugcagacuaaaaauggauaaacuaagacuaaaaggagucucauauaguuuauguacagcagcguuuacauuuacaaagauuccagcagaaacauuacauggaacaguaacuguagaaguacaguaugcaggaacugacggaccauguaaaguuccagcacaaauggcuguugauaugcaaacuuuaacuccaguaggaagauugauuacagcaaaucccgugauaacagaauccacagaaaauucuaaaaugauguuagaacucgaucccccguuuggagauagcuauauaguaauaggaguaggagaaaaaaaaauaacacaccauuggcacaggucagguuccacaauagguaaagcuuuugaagcuacaguaagaggagcuaaaagaauggcuguacuaggagauacagcaugggauuuuggaagcguaggcggagcacuuaauucauuaggaaaagguauccaccaaauauucggagccgcuuucaaaucuuuauuuggaggaaugaguugguuuagccaaauauuaauaggcacucuacuaaugugguuaggacuaaacacuaaaaauggaucuauaucauuaauguguuuagcauuaggcggaguucuaauuuuucucucaacagcaguaucugcu

SEQ ID NO: 2676 - RNA, 2061 nt, Artificial Sequence
  KU955593.1 prME-short CDS opt
acaucaguaggaauaguuggauuauuauuaacaacagcaauggcaguagaaguaacuagaagaggaaaugcauauuacauguacuuagaucgaucagaugccggugaagcgauuagcuuuccaacaaccaugggaaugaacaaaugcuacauacaaauaauggaccuaggccauaugugcgacgcuacaaugucauacgaauguccuauguuagaugagggaguagaaccugaugauguugacuguugguguaauacaacaaguacuuggguaguauauggaacaugccaucauaagaaaggagaagcaaggagaucaagacgagcaguaacacuuccaagccauucaacuagaaaacuucaaacaagaucucaaacguggcuagaaucaagagaauauacaaaacacuuaauaagaguagaaaauuggauuuuccgaaauccaggcuuugcauuagcagcagcugcaauagcuugguugcuaggaaguucaacaucacaaaaaguaauuuaccucguaaugauauuauuaauagcacccgcauacucaauucgaugcauaggaguaaguaacagagacuuugucgaagguaugucaggagggacuuggguagauguaguacuagaacauggagguugcguaacaguaauggcucaagauaaaccaacaguagacauagaauuagucacuacaacgguaucaaacauggccgaaguacgaucauauuguuaugaagcaucaauaucagacauggccagugacuccagauguccaacacaaggugaagccuaucuagauaaacaaagugauacgcaauauguauguaaacgaacacuuguagacagagguuggggaaacggcugcgguuuauuugguaaaggaaguuuaguaacaugugccaaauuugcauguuccaagaaaaugacagguaaaagcauacaacccgaaaauuuggaauaucgaauuauguuaucaguacacggaucacaacacucagguaugauagucaaugauacuggucacgaaacugaugaaaauagagcaaaagucgaaauuacacccaauucgccuagagcugaagcaacguuaggaggauuuggcucauuaggauuagauugcgaaccaagaacaggucucgauuucucagacuuauauuacuuaaccaugaauaauaaacauuggcucguucacaaagaaugguuucaugauauaccucuacccuggcaugcaggagcagauaccgguacaccacauuggaauaacaaagaagcgcuaguagaauuuaaagacgcacaugcaaaacgacaaacuguaguaguuuuaggaucacaagaaggagcaguacauacugcauuagcuggagcauuagaagcagaaauggauggagcaaaaggaagguuaaguaguggucauuuaaaauguagauuaaaaauggauaaguuaagacuaaaaggagugaguuauucacuaugcacagccgccuuuacauuuacuaaaauuccagcagaaacauugcauggaacagucacaguggaaguacaauacgccggaacagacggaccaugcaaagucccagcacaaauggcaguagauaugcaaacauuaaccccaguaggaagacuaauaacagcaaauccuguaauaacugaaucaacggaaaauucaaaaaugauguuggaauuagauccaccauuuggcgauucauauauaguuauaggcgucggagaaaagaaaauaacccaucauuggcacagaucagguucaacaauaggaaaagcauuugaggccacgguaagaggcgcaaaaagaauggcaguauuaggagacacagcaugggauuucggaagcguuggaggagcacucaauagcuuagguaaaggaauccaucaaauuuuuggagcagcguucaaaucauuauuugguggaaugucaugguuuucacaaauauuaauaggaacuuuauuaguaugguuaggacuaaauacuaaaaacggaucuauaagccuaauguguuuagcacucggaggaguauuaauuuuccuaaguacagcaguuagugcu

SEQ ID NO: 2677 - RNA, 2061 nt, Artificial Sequence
  KY272987.1 prME-short CDS opt
acaucaguaggaauaguuggucuauuauugaccacagcaauggcugccgaagugacaagaagagguucagcauauuauauguaucuugaucggucugaugcaggagaagcgauaaguuuuccaacaacucuaggaaugaacaaauguuauauacaaauaauggaccuagggcauaugugugacgcaacaaugaguuaugaauguccaaugcuagaugaaggaguagaaccagacgauguugacuguugguguaauaccaccaguacauggguaguauauggcacaugucaucauaaaaaaggagaagcgcgacguaguagacgcgccguaacacucccaucacauucaacaagaaaacuucaaacaagaagccaaaccugguuagaaaguagagaauacacaaaacaccuuauaagaguagaaaacuggauauuuagaaauccaggcuucgcauuagcagcugcagcaaucgcaugguuacucggaucaucaacaucccaaaaaguaauauaucuagugaugauacuauuaaucgcaccagcauacucaauaagauguauaggaguaaguaacagagauuuuguugaagguaugaguggggggacauggguagauguaguacuagaacauggcggaugcguaacagucauggcucaagauaaacccacaguagauauagaacucguaacaacaacaguaucaaacauggcagaagucagaucauauuguuaugaggcaaguauaagugacauggcaucagacaguagguguccaacccaaggagaagcuuaucuagacaaacaaagugauacccaauauguauguaaaagaacuuuaguagacagaggauggggaaauggaugcggauuauuuggaaaagguucguuaguaacgugcgcaaaauucgcauguagcaaaaaaaugacugguaaaucaauacaaccagaaaaucuagaauacagaauaaugcucucugugcacgguagucaacauucuggaaugauaguaaaugauacaggacaugaaacggaugagaacagagcaaaaguagaaauaacaccaaacaguccaagagcagaagcaacacuaggggguuucgguucuuuaggauuagauugugaaccaagaacaggacuagauuuuagcgaucuauauuauuuaacaaugaacaacaaacauugguuaguacauaaagaaugguuucaugauauaccacucccauggcaugcaggcgccgauacaggcacaccacauuggaauaacaaagaagcacuaguggaauuuaaagaugcacacgccaaaagacaaacuguaguaguacuaggaucacaagaaggagcuguacauacagcauuagcaggugcacuagaggcagaaauggauggagcaaaaggaagauuaucuagcggccaucuaaaaugcaggcuaaaaauggauaaauuaagacuaaaaggagugucauacucucucuguacugcagcauucacuuuuacaaaaauacccgcagaaacguuacacggaacuguaacagucgaaguucaauaugcaggaacagauggaccauguaaaguaccagcacaaauggcaguagauaugcaaacuuuaacuccaguuggccgacuaauuacagcaaauccaguuauuacagagucaacagaaaauagcaaaaugaugcuagaauuagacccaccauucggagauucauauauagucauaggggucggagaaaaaaaaauuacgcaucacuggcacagaagcggaucaacaauaggaaaagcuuucgaagcgacaguaagaggagcaaaaagaauggcaguuuuaggggauacagcaugggacuuuggauccgucgguggagcacuaaauagucuaggaaaaggaauacaucaaauauucggagcggccuuuaaaucgcuauuuggaggcaugucaugguuuagucaaauucuuauagguacuuuacuaaugugguuaggguuaaauacgaaaaacgggucaauaaguuuaguauguuuagcucuaggaggagugcucauauuccuaucaacagcgguaagugca

SEQ ID NO: 2678 - RNA, 2061 nt, Artificial Sequence
  KY007221.1 prME-short CDS opt
acaaguguaggaauuguaggauuauuacugacaacugcuauggcagcagagguuacaagaagaggaagcgcauauuauauguaucuagauagaucagaugcuggugaagcaauuucuuuuccaacaacauuaggaaugaauaaauguuacauacaaauuauggauuuaggacauaugugugacgcuaccaugaguuaugaauguccaauguuagaugaaggaguugaaccagaugacguagauuguugguguaauacaacaucaacauggguaguauaugggacaugccaucauaagaaaggagaagcaagacgaaguagacgagcuguaacauugccaucacauucaacaagaaaauugcaaacuagaucacaaacuuggcuagaaaguagagaauauacaaaacauuuaauccgaguagagaauuggauauuccgaaauccuggauuugcauuagcagcagcagcaauagcguggcuucucgguaguucaacaucacaaaaaguuauauacuuggucaugauauuauuaauagcuccggcauauagcaucagauguaucggaguaaauaaucgagauuucguagaaggaaugucagguggaacguggguagauguaguauuagaacacgguggauguguaacuguaauggcacaagauaaaccaacuguugauauagaacucguaacaacgacaguaaguaauauggcggaaguacgaaguuauuguuaugaagcauccauaucugauauggcaucagacagcagauguccaacccaaggagaagcauaccuggauaaacaaucagauacgcaauauguauguaaaagaacuuuaguugacagaggauggggaaauggaugcggcuuauucggcaaaggaaguuuaguaacaugcgcaaaauuugcguguaguaagaaaaugacaggaaaaagcauacagccagaaaaccuagaauauaggauaauguugaguguacauggcagucaacauaguggaaugauagucaaugauacuggccacgaaacagaugaaaauagggcaaaaguagaaaucacaccaaauagcccucgagcagaagcaacauuaggaggauuuggaucuuuaggucuagauugugaaccaagaacaggcuuagauuuuucagacuuauacuaucuuacaaugaauaacaaacauuggcuaguacauaaagaaugguuucacgauauaccacuaccuuggcaugcaggagcagacacuggaacaccacauuggaauaacaaagaagcacucguagaauuuaaagacgcacaugcaaaaagacagacagugguaguuuuaggaucacaagagggagcaguacauaccgcauuagcaggagcucucgaagcugaaauggauggagcaaaaggaagauuaucaagcggacauuuaaaaugcagacuaaaaauggacaaauuaagauuaaaagguguaaguuacagucuauguacugcagcauuuacauucacuaaaauaccagcggaaaccuuacauggaacgguaacaguagaagugcaguacgcugguacggauggacccuguaaagucccugcacaaauggccguagauaugcaaacucuaacaccuguaggacgacuaauuacagcuaauccaguaauaaccgaaagcacagaaaacucuaaaaugauguuagaauuagauccuccuuuuggagauucauacauuguuauaggaguaggcgaaaagaaaaucacacaccauuggcauagauccggaaguacaauaggaaaagcauuugaggccacaguaagaggcgcaaaaagaauggcaguacuaggagacacagccugggauuuugguucuguaggaggagcauuaaacaguuuaggcaaaggaauacaucagauuuucggagcagcauuuaaaucauuauucgggggaaugaguugguuuucacaaauacuuauaggaacacuacuaauguggcuggguuuaaauacuaaaaauggaagcauaucccuaguuugccuagcacuaggaggaguucugauauuucuaucaacagcuguaagugca

SEQ ID NO: 2679 - RNA, 2061 nt, Artificial Sequence
  EU545988.1 prME-short CDS opt
acgucaguaggaauaguaggguuacuuuuaacgacagcaauggcaguagaaguaacacgaagaggauccgcauauuacauguaucuugaccgaucagaugcaggagaagcaauaaguuucccaacaacacuaggaaugaauaaaugcuauauacaaauaauggauuuaggucacaugugcgaugcaacaauguccuaugaauguccgauguuagaugaagguguggaaccugaugauguagauuguugguguaauacuacaucuacauggguugucuacggcacaugucaucauaagaaaggagaagcgcgaaggaguaggagagcaguaacacuaccgucacacagcacaagaaaauuacaaacuagaucacaaaccugguuggaauccagagaauauacaaaacauuuaaucagaguagaaaauuggauauuuagaaauccaggguuugcuuuagcagcagcagcaauagcaugguuauuaggaaguucaacuagccaaaaaguuaucuaccuaguaaugauucuauuaauagcaccagcguauucaauaagauguauagggguaaguaauagagacuucguagaaggaaugaguggaggaacuuggguagacgugguauuagaacauggaggaugcguaacagugauggcacaagacaaaccagcaguagacauagaauuaguaacaacaacaguaagcaauauggcagaaguaagauccuauuguuaugaagcaucaauaucagauauggcaagcgacucgagauguccgacacaaggagaggcuuaucuagacaaacaaagcgauacccaauauguaugcaaaagaacauuaguagauagaggaugggguaaugguugcggauuauucggaaaaggaucucuagucacaugugcuaaauucgcauguucaaagaaaaugacaggcaaaaguauacaaccagaaaauuuagaauacagaauaauguuaagcguucauggaagucaacauaguggaaugauaguaaacgauacgggacacgaaacggaugaaaauagagcgaaaguggaaauaacaccuaauucaccaagagcagaagcuacacuagguggauuuggaucucuaggacuggacugugaacccaggacaggucuagauuuuagcgaccuauauuacuuaacgaugaauaauaaacauuggcuaguucauaaagaaugguuucaugacauaccauuaccauggcaugcuggagccgacacagguacaccacauuggaauaauaaagaagcauuaguagaguucaaagaugcucaugccaaaaggcagacaguuguuguacuagggucacaagaaggagcaguacauacagcucuagcgggagcacuagaagcagaaauggauggagcaaaagggcgauuaagcucuggacauuuaaaauguagauuaaaaauggauaaauuaagauuaaaaggaguaaguuauucauuaugcacagcggccuuuacauucacaaaaauaccagcagaaacacuacaugggacagugacaguagaaguucaauaugcaggaacagacggaccuugcaaaguuccggcacaaauggcaguugauaugcaaacacuaacaccagugggaagauuaauaacagcaaacccaguuauaacagaaaguacagaaaauagcaaaaugaugcuggaauuagauccaccauuuggugacaguuacauaguuauaggagugggagaaaagaaaauaacacaucauuggcauagaucugggagcacaauuggaaaagcguucgaagccacaguaaggggugcaaaaagaauggcaguauuaggagauacugcaugggauuuuggaucaguagggggugcuuuaaauucauuaggaaaaggaauacaucaaauuuucggugcagcauuuaaaaguuuauuuggaggaaugucaugguucagucaaauccucauuggaaccuuauuagucuggcugggauuaaauacuaaaaacgguucuauaaguuuaaccugucuagcacuaggaggcguauuaauuuucuuaagcacagcaguuagcgca

SEQ ID NO: 2680 - RNA, 2061 nt, Artificial Sequence
  KU681082.3 prME-short CDS opt
acgucaguagggauagucggauuauuauuaacaacugcuauggcaguugaaguuacaagaagaggaagugcauacuauauguaucuugauagaucagaugcgggugaagcaauaucauuuccuacuacacuuggaaugaacaaauguuauauacaaauaauggaucuaggacauaugugugaugcaacaaugagcuacgaauguccgauguuagacgaaggaguagagccagacgauguagauuguugguguaacacaacaucaacaugggucguuuauggaacgugucaccacaaaaaaggagaagcaagaagaucgcgaagagcaguuacacuaccaagccauaguaccagaaaacuacaaaccagaucacaaacauggcuagaaucacgugaauauacaaaacaucuaauacgaguugaaaauuggauauuuagaaauccagguuuugcacuagcagcagcaguaauagcauggcuacuaggaucgucaacaagucaaaaagucauauacuuagucaugauccuacuaauagcaccagcuuacuccauaagauguauaggaguaagcaacagggauuuuguugaagguaugaguggcggaacauggguugauguuguacuagaacacggggguuguguaaccguuauggcacaagacaaaccaacaguagacauagaacugguaacaacaacaguaucaaauauggcagaaguucgaaguuauuguuaugaagcaaguauuagcgacauggcuagugauucaagauguccaacacaaggugaagcauauuuagauaaacaaucugauacacaauacgucuguaaaagaacacuugucgacagaggauggggaaauggaugugguuuauuuggaaaaggaagccucguaacuugugcuaaauuugcauguaguaaaaaaaugacgggaaaaaguauacaaccagaaaauuuagaauauagaauaauguuaagugugcacggaucacagcauucagguaugauuguaaacgacacaggacaugagacugacgaaaauagagcaaaaguagaaauaacaccgaacagcccuagagcagaagcaacacuuggagguuuuggaucauuaggucuugauugugaaccuagaacagguuuagauuucagcgacuuauauuaucuaacaaugaacaauaaacauugguuagugcacaaagaaugguuucacgacauaccgcugccauggcaugcaggagcagacacaggaacaccucauuggaauaauaaagaagcgcuaguugaauuuaaagaugcacacgcaaaaagacaaacaguaguuguacuaggaagccaagaaggcgcaguucauacagcguuagcaggagcucuagaggcagagauggauggcgcaaaagggagauuaaguaguggacauuugaaauguagacuaaaaauggauaaauuaagauuaaaaggaguaucauauagccuaugcacagcagccuuuacauuuacaaaaauaccagcagaaacauuacauggaacuguaacuguggaaguacaauaugcaggaacagauggcccauguaaaguaccagcacaaauggcugucgacaugcaaacacuaacaccaguuggaagguugauaacugcaaauccagugauuacagaaucaacagaaaauucaaaaaugauguuagaguuagacccaccauuuggagauagcuacauaguaauuggcguaggagaaaaaaaaauuacgcaucauuggcacagaagcggauccacaauaggaaaagcauuugaagcaacaguaagaggagcaaaaaggauggcaguguuaggagauacagcaugggauuuuggaagugucggaggugcucuaaacucauuagguaaagguauacaucaaaucuuuggggcagcauuuaagucgcuauuuggaggaaugagcugguuuagccaaaucuuaauugguacacuacuagucuggcuaggauuaaacacaaaaaaugguucaauaagcuuaaccugucuagcauuagggggcguacuaaucuucuuaucaacagcaguaagugca

SEQ ID NO: 2681 - RNA, 2061 nt, Artificial Sequence
  KX601167.1 prME-short CDS opt
acaucaguggguaucguaggauuauuacuuacaacagcaauggcaguugaaguaacaaggaggggauccgcauauuauauguacuuagacagaagugacgccggugaagcaauaucauuuccaacaacacuaggaguuaauaaauguuauauacaaauuauggaccuaggacacaugugugaugcaacaauguccuacgaauguccaaugcuagacgaaggaguggaaccagaugauguagauuguugguguaauacaacaaguacauggguaguuuaugggacaugucaucauaagaaaggagaagcacgaagaucaaggagagcugucacauuaccaucacacaguacgagaaaacuacaaacaagaagucaaacauggcuagaaucaagggaauauacuaaacaucuuauaaggguugaaaauuggauauucagaaauccaggauucgcacuagcagcugcagcuauagcguggcuuuuggguaguaguacuagccaaaaagucauauauuugguuaugauucuacuaauugcaccggcauauuccauacguuguauaggaguaucaaauagagacuuuguugaaggaaugucaggaggaaccuggguagauguaguacuagaacacggaggcuguguuacggucauggcacaagauaaaccaacaguagauauagaacugguuacaacaacaguaagcaauauggcugaaguacgaagcuacugcuacgaagcaaguauaucagauauggcaucagacucacgauguccaacacaaggagaagcauauuuagauaaacaaagugauacucaauauguauguaaaagaacucuaguagauagaggaugggggaaugggugcgguuuauucggaaaagguagucuaguuaccugugccaaauuugcaugcucaaagaaaaugacuggaaaaaguauacagccugaaaauuuagaauauagaauaaugcuaucaguacauggaagucaacauuccggaaugauagucaaugauacaggacaugaaacagaugaaaauagagcaaaaguagaaauuacaccaaacaguccaagagcagaagcaacauuaggagguuuugguucauuaggauuagauugcgaacccagaacaggacuagacuuuagugacuuauauuaccuaacaaugaauaauaaacauugguuagugcauaaagaaugguuucaugauauaccauuaccauggcacgcaggagcugauacgggaacaccacacuggaauaauaaagaggcucugguagaauuuaaagaugcacacgcaaaaagacaaacaguaguuguuuuggguagccaagaaggugcaguucacacagcguuggccggagcauuagaggccgaaauggauggugcaaaaggaagacuaucaaguggacaucuaaaauguagacuaaaaauggacaaauuaagauuaaaaggaguaaguuauagccuaugcacagcugcauuuacauucacaaaaauaccagccgaaacauuacauggaacaguaacaguagaaguucaauaugcaggaacagacggaccaugcaaaguaccugcacaaauggcugucgauaugcaaacauuaacuccaguuggaagauugauaacagcaaauccaguaauaacagaaaguaccgaaaacagcaaaaugauguuagaacuugauccaccuuuuggugauaguuauauagugauuggcguaggagauaagaaaauuacacaccauugguauagaucaggaucaacaauaggaaaagcauucgaagcaacuguaagaggagcaaaacgaauggcaguauuaggagacacugcaugggauuuuggaagcguaggaggagcguuaaauucacuaggcaaaggaauacaucaaauauuuggagcagcauuuaaaaguuuguuuggcggaaugagcugguuuagucaaauauuaauaggaacauuauuaguaugguuaggacuaaacacgaaaaauggaucaauaagucuaacauguuuagcucuagguggaguauuaauauuuuuaaguacagcaguaucagca

SEQ ID NO: 2682 - RNA, 2061 nt, Artificial Sequence
  KX694533.2 prME-short CDS opt
acaucaguuggaauaguuggacuauuacucacuacagcaauggcaguagagguaacacgaagaggcucagcauauuauauguaccuugauaggucagaugccggaaaagcaauuucauuuccaacaacauuagguguaaacaaaugcuauauacaaauaauggaucuaggccauaugugugaugcaacuaugucauaugaaugcccaauguuagaugaaggaguagaaccagaugauguagacuguugguguaauacuacaaguacuuggguaguauauggaacaugucaccauaaaaaaggagaagcaagaagaagcaggagagcagucacauugcccucacauucuacaagaaaauugcaaacgagaagccaaacuugguuggaaucaagagaauacacaaaacacuuaauaagaguagaaaauuggauauuuagaaacccaggauucgcauuggccgcagcagcuauagcaugguuauuaggaucuucuacgucgcaaaagguaauauaucuaguaaugauauuauuaauagcccccgcguauucaauuagauguauuggaguaucaaauagagacuucguagaagggaugucaggaggaacaugggucgauguuguuuuagaacacgguggaugcgucaccguuauggcacaagauaaaccuacagucgauauugaacuaguaacuacuacugucucaaacauggcagaaguucgaaguuauuguuaugaagcaucaauuucagauauggcaucagauaguagauguccaacccaaggagaagcuuauuuagacaaacaaagcgacacacaauauguuuguaaaagaacauuaguugauaggggcuggggaaaugguuguggauuauucggaaaaggaaguuuaguuacaugugcaaaauucgcuuguucuaaaaaaaugacgggaaaaaguauccaaccugagaauuuagaauauagaauaaugcuaucaguacacggaagucaacacagcgggaugauaguaaaugacauaggacaugaaacggaugaaaauagggcuaaaguagaaauaacaccgaacucaccaagagccgaagcaacacuuggugguuucggaucauuaggacuggauugcgaaccaagaacuggauuagacuucagcgaucuauauuacuuaacaaugaauaauaaacacugguuaguacauaaagaaugguuccaugauauaccauuacccuggcaugcaggagcagauacgggaacaccacauuggaauaacaaagaagcccuaguagaauucaaagaugcacaugccaaaagacaaacaguaguaguucuagggagucaagaaggagcaguacauacugcacuagcaggagcauuggaagcagagauggauggagcaaaaggaagauuaucaaguggucauuuaaaaugcagauugaaaauggauaaauuacgauuaaaaggaguaucauacucucuuugcacagcagcauuuacuuucacuaaaauuccagcugaaacucuucauggaacaguaacaguagaaguccaguacgcgggaacagauggaccaugcaaaguaccugcacaaauggcaguagacaugcaaacauuaaccccaguaggaagauuaauaacagcaaacccuguaauaacagaaaguacugaaaacucuaaaaugauguuagaauuagauccaccuuuuggagauucauauauagucauaggaguuggagauaaaaaaauaacacaccacuggcauaggucaggaagcacaauuggaaaagcauuugaagcuaccguaagaggcgcaaaaagaauggcaguauuaggagacacagcaugggauuucgguucuguaggaggugcguuaaacucauuggguaaagggauacaccaaaucuuuggagccgccuuuaagagccuauuuggaggaaugaguugguuuagucaaauacuaauaggaacacuauuaguaugguugggacuaaauacaaaaaauggaagcauaucacuuacauguuuagcauuaggagguguauuaauauuucugucaacugcaguuagcgca

SEQ ID NO: 2683 - RNA, 2061 nt, Artificial Sequence
  KY288905.1 prME-short CDS opt
acaaguauaggaauuguaggucuacuucucacuacagcaauggcagcugagauaacaagacgggguagugcauacuauauguaccuagacagaagugacgcagguaaagcaauuucauuugcaacuacauuaggcguaaacaaaugucauguacaaauaauggauuuaggacauaugugcgacgcaacaaugucauaugaaugcccuaugcuggaugagggaguugaaccugacgauguagauuguugguguaauacaacaucaacauggguagucuacggaacaugccaucauaagaaaggagaagcaagaagaaguaggagagcagugacacuaccuucucauaguacaagaaaauuacaaacuagaagucaaacauggcuagaaucaagagaauauacaaaacauuuaauaaaaguugaaaauuggauauuuagaaauccaggauuuacauuaguagcuguugcaauagcauggcuauugggaucaaguaccagucaaaaaguuauuuaucuaguaaugaucuuauuaauagccccugcauauagcauacgauguauaggaguuucaaacagagauuuuguagaaggaaugaguggagguaccuggguagauguaguauuagaacauggaggcugcguaacggugauggcucaagauaagccaacaguugauauagaauuaguaacaacaacaguaagcaacauggcagaaguuagaagcuacuguuacgaagcaaguauaagugauauggcaucagauaguagaugcccaacgcaaggagaagccuacuuagauaaacaaagugauacacaauauguaugcaaaagaacauuaguugaucgaggauggggaaacgguugcgguuuauuuggaaaaggaucuuuaguaacuugugcaaaguuuacauguaguaagaaaaugacugguaaaagcauacaaccagaaaaucuagaauauagaauaauguuaucaguacauggaagccaacacagcggaaugauaguuaaugacaccggacacgaaacagacgaaaauagagccaaaguagaaguuacaccaaacaguccucgagcggaagcaacacuaggcggauucggaaguuuaggauuagacugugaaccuagaacaggccuagauuuuagugacuuauacuacuuaacaaugaauaacaaacauugguuaguacacaaagaaugguuccaugacaucccacuaccauggcacgcuggugcagauacuggaacaccacauuggaauaauaaagaagcauuaguagaauuuaaagaugcacaugcuaaaagacaaacaguuguuguuuuaggaucucaagaaggagcaguacauacagcacuagcuggcgcucuggaggcugaaauggauggagcgaaaggaagauuauucucaggacacuuaaaauguagauuaaaaauggauaaauugagacuaaagggaguaaguuauagucuauguacagcagcauuuacguuuacaaaagugccugcagaaacacuacauggaacugucacgguagaaguucaauaugcaggaacugauggaccguguaaaguaccagcacaaauggcaguagauaugcaaacauuaaccccuguaggaagacugauaacagcaaacccgguaauaacagaaaguacagaaaacaguaaaaugauguuagaauuggacccgccauucggagauagcuauauaguaauuggcguaggagauaagaaaauaacucaccauuggcacagaaguggaucaacaauaggaaaagcauucgaagcaacaguaagaggagcaaaacgaauggcaguauugggagauacagcaugggauuuuggaucaguaggaggcguauuuaacucgcuaggaaaagggauacaucaaaucuuuggagcagccuucaaaaguuuauuuggaggaaugagcugguuuagucaaauacuuauaggaacacuauuaguaugguuaggauuaaacacuaaaaacggaaguaucucuuuaacauguuuagcauuaggaggagugaugauauucuuaucgacagcugugagcgcg

SEQ ID NO: 2684 - RNA, 2061 nt, Artificial Sequence
  KF268950.1 prME-short CDS opt
acaaguauaggaauaauaggucucuuguuaacgacagcuauggcagcagaaauaacaagacgagggagugcauauuauauguaccuagaccguucugacgccggaaaagcuauaucauuugccacaaaccucggaguaaacaagugucauguacaaauaauggaucucggucauaugugugacgcgacuaugaguuaugaauguccaaugcuagaugaaggaguagaaccagacgacguugauugcugguguaauacaacaagcacuuggguaguauauggaacaugucaucacaagaaaggggaggccagaagaucaagacgagcaguaacauuaccaucccacagcacaagaaaauuacaaacaagaagucaaacaugguuagaaaguagagaauauacuaaacauuuaauaaaaguugaaaauuggauuuucagaaauccaggauucgcauuagcagcaguagcaauagccuggcuauuaggaucaucaacuucacaaaaaguaauuuaucuggucaugauauuacuaauagcaccagcauauagcauaagaugcauaggaguaaguaacagagauuuuguagaaggaaugaguggaggaacauggguugaugucguauuagaacauggagguuguguaacuguuauggcgcaagauaaaccaacaguagacaucgaauuaguuacaacaacaguaagcaauauggcugaaguaaggaguuauuguuaugaagcauccauuucggauauggccucagauaguagaugcccuacacaaggagaagcauauuuagauaaacaaucagacacacaauaugucugcaaacgaacucuagucgauagaggaugggguaauggcuguggccuauucgguaaaggaucccuaguaacaugcgcaaaauucacaugcucuaagaaaaugacagggaaaucaauccaaccugaaaauuuggaauaucgaauaauguuaaguguacacgggagucaacacucaggaaugauaguaaaugauauagggcaugaaacagaugaaaacagagcaaaaguagaaguaacgccuaauucaccaagagcugaagcaacacuagguggauuugggaguuuaggauuagacugugaaccaagaacaggauuagauuucucagaccucuacuacuuaacaaugaauaauaaacacuggcuaguacauaaagaaugguuccaugauauuccuuuaccauggcacgcaggagcagauacaggcacaccucauuggaacaauaaagaagcucuaguagaauuuaaagaugcacaugcaaaaagacaaacugugguuguauuagguucacaagaaggagcaguacauacagcacuagcuggcgcauuggaagcagaaauggacggagcaaaagguaggcucuuuaguggacaucuaaaauguagguuaaaaauggacaaacuuagguuaaaaggaguaucauacucacuaugcacugcugcuuucacauucacaaaaguacccgcagaaacauuacacggaacagugacaguugaaguacaauaugcuggaacugauggucccuguaagguaccagcacaaauggccguagauaugcaaacauuaacuccaguagguagacuaauaaccgcaaauccaguaauuacagaauccacagaaaauaguaagaugaugcuagagcuagauccaccauuuggagauaguuauauagucauaggaguaggugacaagaaaaucacacaucacuggcauagaaguggcagcacaauuggaaaagcauuugaagcaacaguaagaggagcaaaaagaauggcaguauuaggugauacagcaugggauuuuggaaguguagguggaguuuuuaauucacuaggaaaaggaguacaucaaauauuuggagccgcuuucaaaucacuauuuggaggaaugaguugguuuucucaaauauuaauaggaacauuauuaguaugguuaggucuaaacacuaaaaauggaucaaucucauuaacauguuuagcacucggaggaguuaugauuuuccuaagcacagcaguaagcgca

SEQ ID NO: 2685 - RNA, 2061 nt, Artificial Sequence
  KF383121.1 prME-short CDS opt
acuucaauagguauaauaggucuauuacuaacaacagcaauggcugcagaaauaacacgaagaggaucagcuuacuacauguaucuagacagaagugaugcuggaaaagcaauuagcuucgcaacaacacucggaguuaauaaaugccacguucaaauaauggacuuaggacauaugugugaugcaacuaugaguuacgaauguccaaugcuugacgaagguguugaaccagaugauguagacuguugguguaauacgacuagcacguggguaguauacggaacaugucaucauaaaaaaggcgaagcuagaagaagucgacgagcaguuacacuaccgagucacaguacaagaaaacuacaaacacgaucacaaacaugguuagaaaguagagaauauacaaaacaccuaauaaagguugagaauuggaucuucagaaauccgggguucgcucuuguagcaguagccauagcaugguuauuaggaucuagcacaucacaaaaaguaaucuaucuaguuaugauacuuuugauagcaccagcuuauaguauaagauguauuggaguaucaaauagagacuucguagaaggaaugucuggaggaaccuggguagauguaguauuagaacacggcggaugcguuacaguaauggcccaagauaaaccaacaguagacauagaauuaguaaccacgacaguaaguaauauggcggaagugagaaguuauugcuaugaagcaaguauaucagauauggcaucagauucacgaugcccaacacaaggagaagccuauuuagauaaacaaagcgauacacaauacguuugcaaaagaacucuaguagacagaggauggggaaauggauguggauuauucggaaaaggaucuuuaguaaccugugcaaaauuuacaugcaguaaaaaaaugacagguaaaaguauacaaccagaaaauuuagaauauagaaucaugcuuucaguacacggaucacaacauagcgguaugauaguaaacgacauaggacaugaaaccgaugaaaauagggcaaaaguagagguaacaccaaacucaccaagagcagaagcuacuuuaggaggauuuggaucauuaggguuggauugugaaccacgaaccggacuagauuuuagugaucuauacuaucuaacaaugaauaacaaacauugguugguacauaaagaaugguuucacgacauuccucuaccauggcaugcuggugcagauacuggaacaccacauuggaauaauaaagaagcacuaguagaguuuaaagaugcccaugccaaacgacaaacaguaguaguacuaggaagucaagaaggagcaguacauacagcauuagcuggagcauuagaagcggaaauggauggagcaaaaggaagacuauucaguggucaccuaaaauguagauuaaaaauggauaaauuaagauuaaaaggagugucauauucccuaugcacagcggcauucacauuuacgaaaguuccagcagaaacacuccauggaacagugacaguagagguacaauacgcuggaacugaugguccaugcaaaguaccggcacaaauggcgguugauaugcagacauuaacaccaguagggagguuaauaacagcaaauccaguaauuacagaaagcacagaaaacucuaaaaugaugcuagaguuagauccacccuuuggagacaguuacaucguaauaggaguaggagauaaaaaaauaacgcaucauuggcauagaucagguucuacuauuggcaaagcuuuugaggcaacaguaagaggagcaaaaaggauggcagucuuaggugauacggcaugggauuuuggcucuguaggaggaguuuuuaacaguuuagguaaaggaauucaccaaauauuuggagcggcauuuaaaagcuuauuuggaggaaugaguugguuuucacaaauacuuauagguacguuauuagucuggcuuggauuaaacacaaaaaauggaaguauaucacuaacuugcuuagcauuaggaggcguaaugauauuuuuaaguacugcaguaagugcu

SEQ ID NO: 2686 - RNA, 2043 nt, Artificial Sequence
  KF268949.1 prME-short CDS opt
acaagcauuggaauuauaggacuauuauuaacaaccgcaauggccgcagaaauaacgagacguggaagcgcauacuauauguauuuagaccgaucugaugcaggaaaagcuauuucuuuugcgacaaauuuaggaguuaauaaaugccauguucaaauaauggaucuaggacauaugugugaugcaacaaugucauaugaauguccaauguuagaugaaggaguagaaccagacgacguagauuguuggugcaacacaacaucaacauggguaguauacggaacgugucaccauaagaaaggugaagcaagaagaucuaggagagcaguaacauuaccaucgcauagcacaagaaaacuacaaacaagaagucaaaccuggcuagaaucaagagaauacacaaaacaccucauaaaaguggaaaauuggauauucagaaacccaggauucgcuuuagcagcaguagcaauagcauggcuuuuaggaagcaguacaucccaaaaaguaauauauuuaguuaugauauuauuaauagcuccagcauacucaaucaggugcauaggaguaaguaauagggauuucguugaaggaaugucaggaggaacauggguagacguaguauuagagcacggagguugcguaacgguaauggcacaagacaaaccaacaguggauauagaauuaguaacaacaacuguuaguaauauggcggaaguacgaucauauugcuaugaggccucuauaucagacauggcaucagacagcagaugcccaacccaaggagaggcuuacuuagauaaacaaagugacacacaauacguauguaaaagaacacucguugaucgaggcuggggaaauggaugcggauuauuuggaaaaggaucuuuaguuacaugcgcaaaauuuacauguaguaagaaaaugacagggaaaagcauacaaccagaaaauuuagaauauagaauaaugcuaucuguacauggaucacaacauucagggaugauaguaaacgaugaaaaccgagcaaaagucgaaguaacuccaaauucaccucgagcggaagcaacguuaggugguuucgguaguuuagguuuagauugcgaaccuagaacaggacuggauuucagcgauuuauauuaccuaacuaugaacaauaaacauugguuagugcauaaagaaugguuucacgauauaccacucccauggcacgcaggagcugauacaggaacaccacauuggaauaauaaagaagcucuaguagaauuuaaagaugcacacgcaaaaagacaaacaguagugguacuaggaagucaagaaggagccguacauacagccuuagcaggagcauuagaagcugaaauggauggugcaaaaggaagguuauuuucaggacauuuaaaauguagacucaaaauggauaaauuaagauuaaaagguguaaguuauucacuaugcacagcagcuuuuacauuuacaaaaguaccagcagaaacacuacacgggacagugacaguagaaguacaguacgcaggaacagaugggccauguaaaguaccagcacaaauggcuguagacaugcagacauugacaccgguuggaagauuaauaacagcaaauccaguaauaacugaaaguacugaaaauucaaaaaugaugcuagaacuagacccaccauuuggcgacuccuauauaguuauaggagugggugauaagaaaaucacacaucauuggcauagaucaggaaguacgauaggaaaagcguuugaagccacgguuagaggagcuaaaagaauggcagugcuaggagauacggcuugggauuuuggaaguguaggaggcguguuuaauagccuagggaaaggaauacaucaaauauuuggggcagcuuucaaaagucuauuuggagguaugaguugguuuagucaaauauuaauagguacacuauuaguaugguuaggauugaacacuaaaaaugggagcauuaguuugacuuguuuagcacuaggugguguaaugauauuuuuaucaacagcaguaagugca

SEQ ID NO: 2687 - RNA, 2061 nt, Artificial Sequence
  KU955595.1 prME-short CDS opt
accucaauugguauugucggacuacuccuaacaacagcaauggcagcagaaaucacucgaaggggaucggcguacuauauguaucuugauaggagcgacgcaggaaaagcaaucucguuugcuacaacauuaggaguaaacaaaugccauguacaaauaauggauuugggacauaugugcgaugcaacaauguccuaugaguguccuauguuggacgaaggaguugaacccgacgacguagacuguugguguaauacgacaagcacauggguuguauaugguacaugucaucauaaaaaaggugaagcuagaagaucucggcgagcagugacauuaccaucacauucaacaaggaaacuacaaacuagaucacaaacaugguuagaaucacgagaauauacgaaacaucuaaucaaaguagaaaacuggauuuuucguaacccaggauuugcccuuguagcaguagcaauagcauggcuucuaggaucgaguacaucccaaaaaguaauuuauuuaguaaugauacuauuaauagcaccagcauauagcauaagauguauaggaguuaguaacagagacuucgucgaaggaaugucaggcggaacauggguugauguaguccuagaacacggcggauguguaacaguaauggcucaagauaaaccaacaguagauauagaacucgucacgacaacaguaucaaauauggccgaaguaagaaguuauuguuaugaagcgaguauuagugacauggccucagauucaagauguccaacccagggcgaagcauaucuugauaaacaaucugacacacaauauguaugcaaaagaacacuuguagacagaggauggggaaauggaugcggacuauuuggaaaaggaagccuaguaacaugugcaaaauucacuuguucaaaaaagaugacaggaaaaagcauucaaccugaaaacuuagaauaucgaauaauguuaucuguucauggaucacaacauucuggaaugauaguaaaugacacuggacaugaaacugacgaaaacagagcaaaaguagaagucacacccaauucaccaagagcagaagcuacacuaggaggauuugguagucuaggucuagauugugaaccaagaacuggacuagauuucucagacuuauacuaucugacaaugaauaacaaacacugguuaguacauaaggaaugguuucaugacauaccucucccuuggcacgcaggagcagauacagguaccccacauuggaacaauaaagaagcacuaguagaauuuaaagacgcccaugcaaaaagacaaacaguaguagucuuaggaagccaagaaggagcaguacauacagcauuagcaggagcucuagaagccgaaauggacggagcaaaagguagacuauuuucuggucaucuaaaaugccgacuaaaaauggacaaauuaagacuaaaagguguaucauacagcuuaugcacagccgcauuuacauucacuaaagucccagcagaaacauuacacgggacaguaacaguagaaguacaauaugcaggaacagacggaccaugcaaagucccagcacaaauggcaguagacaugcaaacauuaacuccaguaggaagacuaauaacagcuaacccaguuauuacagaaucgacagaaaauucaaaaaugaugcuagaacuugauccaccauuuggugauucauauauaguuauaggaguaggagauaaaaaaauaacacaucauuggcauagaucaggaucaacaauaggaaaagcauuugaagcaacaguaaggggcgccaaaagaauggcaguauuaggagacacagcaugggauuuugguucuguuggagguguauucaauucauuaggaaaaggaauccaccaaauauuuggagccgcauuuaaaucucuauuuggaggaaugucaugguucucacaaauauuaauaggaacauuguuaguauggcuaggauuaaacacgaaaaaugggucaauuagucuaaccugucuagcauugggaggaguaaugauauuucuaucaacagcaguaucagca

SEQ ID NO: 2688 - RNA, 2061 nt, Artificial Sequence
  KF383116.1 prME-short CDS opt
acaucuaucgguauaguaggauuacuauuaacaacggcaauggccgcagagauaacucgaagaggaucagcguacuauauguacuuagauaggucugacgccggaaaagcaauaaguuuugcuacuacauuaggaguaaauaaaugucacguacaaauaauggaucuaggacauaugugugacgcuacuaugucauaugaaugcccaauguuagaugaaggcguugaaccggaugauguagauuguuggugcaauacuacaucaacauggguaguauauggaacaugucaacauaagaaaggugaagcccgaagaagucggagagcugucacauuaccaucacacucaacaagaaaauuacaaacaagaucacaaacaugguuagaauccagagaauacacaaaacaucuaauaaaaguugagaacuggauuuuuagaaacccaggcuuugcuuuaguagcaguggcaauagcgugguuauugggaaguaguacaagucaaaaagugauauauuuaguaaugauucuauuaauagcuccagcauauaguaucagauguauagguguaucaaauagagauuuuguagaaggaaugagcggaggaaccuggguagaugucguauuagaacauggaggauguguaacuguuauggcacaagacaaaccuaccguagauauagaauuaguaacaacuacuguuaguaauauggcugaagucagaagcuauugcuacgaagcaaguauaagugauauggcaagugauucgagauguccaacucaaggcgaagcauaucuugauaaacaaagcgauacacaauauguauguaaaaggacguugguagauagagguuggggaaacggauguggcuuauucggaaaaggaagucuaguuacuugcgcgaaauuuacauguagcaagaaaaugacagguaaaaguauacaacccgaaaaucuagaauauagaaucauguuaucaguacacggaucacaacauaguggaaugauaguaaaugauauaggacacgaaaccgaugaaaauagagccaaaguugaaguaacgccaaauucgccaagagcugaagcaacauuaggaggauucggaucucuuggauuagauugcgagccaagaacaggauuagacuuuagugauuuauacuaucuaacuaugaauaacaaacauugguuaguacauaaagaaugguuucaugauaucccauuaccuuggcaugcaggagcagauacagggacaccucauuggaauaauaaagaagcauuagucgaguucaaagacgcucaugcaaaaagacaaaccguaguaguacuaggaucacaagaaggagccguacauacggcgcuugcaggagcauuagaagcagaaauggauggagcaaaaggaagauuauuuucuggacauuuaaaauguagauuaaaaauggauaaacugagauuaaaaggaguuucuuauucuuuauguacagcaguuuguacagcagcuaaagucccagcagaaacacuacauggaacaguaacaguagaaguacaauaugcaggaaccgaugguccauguaaaguaccagcucaaauggcagucgauaugcaaacauuaacuccgguaggaagacuaauuacagcuaacccaguaauaacagagucaaccgaaaauagcaaaaugauguuagaauuagauccaccauuuggagauagcuacauuguaauaggaguuggagauaagaaaauaacacaucauuggcauagaucgggaagcaccauugggaaagcauucgaagcgacagugaggggagcaaaaagaauggcaguauuaggagauacagcgugggauuuuggaucuguaggaggaguauuuaauaguuugggaaaaggaauacaucaaauauuuggagcagcauuuaaaucauuauuuggaggaaugagcugguuuucacaaauauuaauaggcacacuauuggucuggcucggacugaauacuaaaaacggaaguauuaguuuaacgugccuagcauuaggaggcguaaugauauuccuuaguacagcaguuucagca

SEQ ID NO: 2689 - RNA, 2043 nt, Artificial Sequence
  KX601166.1 prME-short CDS opt
accucaauaggaauaguaggcuuguuguuaacaacagcaauggcagccgaaauuacaagaagagguuccgcauauuauauguaccuagauagaucagaugcagggaaagcaauaaguuuugcaacaacuuuaggagucaauaaaugucauguacaaauaauggauuugggacauaugugugaugcaacaaugagcuacgaauguccaauguuagaugaaggaguugaaccugacgauguagauuguugguguaauacaacaaguacauggguaguauacggaaccugucaucauaaaaaaggagaagcucgaagaagcagaagggcuguaacacuaccgucucauagcacuagaaaauuacaaacacgaucccaaacauggcuagaaaguagagaauacacaaaacauuuaauaaaaguagaaaauuggauauuuagaaaucccggauucgcuuuaguagccguagcaauugcaugguuauuaggaucaucuacaucacaaaaaguaauauaucuuguaaugauacuauuaauagcgccggcauauaguauuagaugcauaggaguaaguaauagagauuuuguagaaggaaugaguggugguacguggguagaugucguucuagaacacggaggaugcguaacaguaauggcacaagacaaaccgaccguagacauagaauuaguuacaacuaccguuucaaacauggccgaagugagaucuuacuguuaugaagcuucaauaagugauauggcaucagauucaagaugcccuacacaaggagaagcguaccuugacaaacaaucggauacacaauauguaugcaaaagaacacuaguagaucgaggauggggaaacgguuguggacuguuuggaaaaggaaguuugguaacuugugcaaaauuuacauguucaaaaaaaaugacagguaagucaauacaaccagaaaaccuugaguauagaauaaugcuaucaguacauggaagucagcacucaggaaugauaguaaaugacgaaaacagagccaaaguagaaguuacucccaauaguccacgagcggaagcaacauugggaggguuuggaucucuaggucuagauugcgaaccgagaaccggauuagauuucagugauuuauauuauuuaacaaugaauaauaaacacugguuaguucacaaagaaugguuccacgauaucccauuaccauggcaugcuggagcggauacgggcacaccacauuggaauaacaaagaagcacuaguugaauuuaaagaugcacaugcaaaacgucaaacaguaguaguauuaggaucccaagaaggcgcuguacauacagcacuagcaggugcauuagaagcugaaauggauggugcuaaaggacgcuuauuuucaggacaucuaaaaugucgucuaaaaauggacaaauuaagacuuaaaggaguaaguuauagcuuauguacugcagcauuuacuuuuacaaaaguaccagcugaaacauuacacggaacagugacaguugaaguacaauaugcugggacagacggaccauguaaaguaccagcccaaauggcaguagauaugcaaacauuaacgccuguaggucguuuaauaacugcuaacccugucauaacggaaucaacagaaaauucaaaaaugauguuagaauuagauccaccuuucggagacucauacauaguaauaggaguuggagacaagaaaauaacucaccacuggcauagaucaggaaguacgauugguaaagcauuugaagcaacggugagaggagcaaaaagaauggcaguauuaggggauacagcgugggauuuuggaaguguaggaggaguuuuuaacucauuaggaaaagguauacaccaaauauuuggugcagcauuuaaaucucuauuuggagguaugucaugguuuucacaaauauuaauagguacacuauuaguaugguugggacuaaauacaaaaaauggaucaauaucucuaacaugcuuagcuuuaggaggaguaaugauauuuuuaaguacagcagugucagca

SEQ ID NO: 2690 - RNA, 2061 nt, Artificial Sequence
  KF383118.1 prME-short CDS opt
acuucaauaggaauaaucggguuacuauuaacaaccgcaauggcagcugaaauaacccgaagaggaucagcauacuauauguaccuagauagaucagacgcaggaaaagcaauaagcuuugcaacgacgcucggaguaaacaaaugucauguccaaauaauggauuugggacacaugugugacgcaacuaugucauacgaauguccaaugcuugaugaaggaguagaaccagaugauguagauuguugguguaacacaacuucaacauggguaguauacggaacuugucaucauaagaaaggagaaaccagacgaagccgaaggucaguuagucuaagauaucacuacacaagaaaacuacaaaccagaucacaaacauggcuagaaucaagagaauauaaaaaacacuuaauuaugguagagaauuggauauuucguaauccagguuuugcaauagugaguguagcaauuacuuggcuuaugggaaguuuaacuagucaaaaaguuauauauuuaguaaugauaguacuaaucguaccagcauacagcauaucaugcauaggaguuaguaacagagaucuaguugaaggaaugucaggaggaacuuggguagacguuguauuagaacacggaggauguguaacagaaauggcgcaagacaaaccgacagucgauauagaauugguaacaaugacaguaagcaauauggcagaaguaagaucauauuguuaugaagcaucacuaucugacauggcaucggcaucacgaugcccaacacaaggugaaccaaguuuagauaaacaaagugauacacaaagcguuuguaaaagaacauuaggugauagagguuggggaaacgguuguggaauauuuggaaaaggaucacucguaacauguucuaaauuuaccuguuguaaaaaaaugccaggaaaauccauucaacccgaaaauuuggaauauagaauaaugcugcccguacauggaagucaacauaguggaaugauaguaaaugauauaggacaugaaacagaugaaaaucgugcaaaaguugaaguaacaccaaauucaccuagagcagaagcaacguuaggaggauuuggaagucuaggcuuagauugugaaccaagaacaggauuagauuuuuccgauuuauauuaucuaacaaugaauaacaaacacugguuaguacauaaagaaugguuucaugauauaccauuaccauggcaugcgggagcugacacuggaacaccacauuggaacaauaaggaagcgcuuguagaauucaaagaugcacacgcaaaaagacaaacaguaguaguacuaggaucacaagaaggagcaguacauacagcauuagccggagcacuagaagcagaaauggacggagcaaaagguagacuauucaguggucauuuaaaaugcagguuaaaaauggauaaacuccguuuaaaaggaguuucuuauaguuuauguacagcagcauuuacauuuacuaaaguaccugcagaaacauuacauggaacaguaacuguagaaguacaaucagccggaacagauggaccuugcaaaguaccugcacaaauggcaguagauaugcaaacacuaacaccgguaggaagacuaauaacagcaaaccccguaauaacugaaucaacagaaaacucuaaaaugaugcuagaacuagauccuccuuuuggugacucauauaucgugauaggcguaggagauaaaaaaaucacacaucacuggcacagaucaggaucuaccauaggaaaagccuucgaagcaacaguaagaggagcaaaaaggauggcaguguuaggcgauacagcuugggauuuuggcagcguaggcggaguauuuaacucacuuggaaaaggaauacaucaaauauuuggcgcagcauucaaaucccuauuuggaggaaugaguugguuuucacaaauauuaauagguacauuacuuguaugguuagguuuaaauacaaaaaacggcucaaucaguuuaacuugccuagcuuuaggaggaguaaugauauuucuaagcacagcagugagcgcc

SEQ ID NO: 2691 - RNA, 2058 nt, Artificial Sequence
  KX447520.1 prME-short CDS opt
aguguuggaauaguaggauuauuacuuacaacagcuauggcagcagaggucacaagacgaggaucagcuuacuauauguauuuagacaggaaugaugcuggugaagcaauaucauucccgaccacccuggguaugaacaaauguuacauacaaauuauggaucuuggacacaugugugacgcaacuaugucauaugaauguccaaugcuagaugaaggaguagaaccagacgauguagacugcuggugcaacacaacaagcacuuggguaguauauggcaccugucaucauaaaaaaggagaagcuagaagaaguagaagagcaguaacauuaccaagccauuccacuagaaaauuacaaacaagaucacaaacaugguuagaauccagggaauauacaaagcaccucauaagagucgaaaauuggauauuuagaaacccaggauucgcccuugcagccgcagcaauagccugguuacuuggaucgagcacaagucaaaaaguuaucuaucucguaaugauauuauuaauagcaccagcauauagcauacgauguauuggcguaucgaauagagauuuuguagaaggaaugagcggaggaacauggguagacgucguucuagaacaugguggaugcguaacaguaauggcacaagauaaaccuacaguugauauagaauuaguaacaacaacaguaaguaauauggcagaaguaaggagcuauugcuacgaagcaucaaucagugauauggcauccgauucaagauguccaacacaaggagaagcauacuuagauaaacaaucagauacacaauauguauguaaacguacacuuguagacagaggauggggaaacggauguggucuauucggaaaggguagccuaguaacaugcgcaaaauucgcaugcaguaaaaaaaugacugguaaaagcauacaaccagaaaaucuugaauauagaauaauguuaucaguacauggaagucaacauucugggaugauaguuaaugauaccggacaugaaacugaugaaaacagagcaaaaguugaaauuacuccaaauucaccaagagcagaagcaacauuagguggcuuuggaaguuugggacuugauugcgaaccuagaacaggacuagacuuuagugauuuguauuacuuaaccaugaacaauaaacauugguuaguacauaaagaaugguuccaugacauuccauuacccuggcaugcuggagcggauaccgggacaccacauuggaacaacaaagaagcauuaguagaauuuaaagacgcacacgccaaaagacaaacuguaguaguacugggaagccaagaaggagcaguacauacagcgcuagcaggagcauuagaagcagaaauggauggugcaaaaggaagauuaagcucaggucauuuaaaaugcagacuaaaaauggacaaacuuagauuaaaagguguaaguuauucacuauguacugcagcuuucacauuuacuaaaauaccagcagaaacacuacauggcacaguuacuguagaaguccaauacgcaggaacagauggaccuuguaaaguucccgcacagauggccguagauaugcaaacacuuacuccaguaggccgacuuauaacagcaaacccuguaauaacagaaucaacagaaaauuccaaaaugauguuggaauuagaccccccguuuggugauaguuacauaguaauaggagucggggaaaaaaaaauaacccaucacuggcaucgauccggcagcacaauaggaaaagcauuugaagccacuguaagaggagcaaaaagaauggcgguauuaggagauacagcaugggauuuuggaagcguagguggcgcacuaaauuccuuaggaaaagguauacaucaaauauuuggagcugcauuuaaaucucuuuuugggggaaugucaugguuuagucaaauuuuaauaggaacucuauuaaugugguuaggucucaauacaaaaaacggaucaauaaguuuaauguguuuagcuuugggaggaguccuaauauuuuuaagcacggcuguaagcgca

SEQ ID NO: 2692 - RNA, 2061 nt, Artificial Sequence
  KU761561.1 prME-short CDS opt
acaucaguagguauaguaggacuacuguuaacaacagcaauggcagcagaaguaacuagaagaggaucggcauauuauauguaucuugaccggaaugaugcgggagaagcuauaagcuuuccaacuacuuuaggcaugaauaaauguuauauccaaauaauggaucuaggacauaugugugacgcaacaaugaguuacgaauguccaauguuagacgaagggguagagccugaugacguagauugcuggugcaacacgacaaguacaugggucgucuauggaacaugucaucauaaaaaaggagaagcacgaagaaguaggcgagcaguaacucuucccucacacaguacacgaaaauuacaaacaagaagucaaacaugguuagaaucccgagaguauacaaaacacuugauaagaguagaaaauuggauuuuuagaaauccaggauuugcacuagcagccgcagcaaucgcauggcuacuuggaagcaguacaagucaaaaagucauuuauuuagucaugauauuauuaauugcaccugcauauucaauaagaugcaucggagugucgaauagagauuuuguagaaggaaugaguggaggaacauggguagauguaguauuagaacauggaggcuguguaacugucauggcccaagauaaacccacaguagauauagaauuaguaacgacaacaguaucaaauauggcagaaguaagaucauacuguuaugaggcuaguauuucagacauggcaagugauucuagaugucccacgcaaggugaagcauaucuagacaagcaaucagauacacaauauguauguaaaaggacauuaguggaucgaggcuggggaaaugguuguggacuuuuugggaaagguucauuagucacaugugcaaaauuugcguguucaaaaaaaaugacaggaaaaaguauccaaccagaaaacuuagaauacagaauaaugcuaucuguacacggaucucaacauaguggcaugauaguaaaugauacgggacaugaaacugacgaaaacagagcaaaaguagaaauaacaccaaacucaccuagagccgaagcaacauuaggcggauuuggaucucuaggauuagauugcgaaccaagaacuggauuagauuucucagauuuauauuaucuaacaaugaauaacaaacauugguugguacauaaagaaugguuucacgacaucccauuaccauggcaugcaggagccgauacuggaacaccacauuggaacaauaaagaagcacuuguugaauuuaaagaugcacacgcaaaacgacaaacuguuguaguucuaggaucgcaagaaggugccguacauacagcgcuugcaggagcacucgaagcagaaauggauggcgcaaaaggaagauuaaguucagggcaucuuaaaugcagacuaaaaauggauaaauuaagguuaaaaggaguuucauauaguuuaugcacagcagcauuuacauuuacuaaaauaccagcggaaacauugcacggaacagugaccguagaagugcaauaugccggaacagacggucccuguaaaguaccagcucaaauggcuguagacaugcaaacguuaacuccagucggaagauuaaucacagcgaacccaguaauaacagaaaguacagaaaauucaaaaaugauguuagaauuagacccaccauuuggugauagcuauauaguaauaggaguaggugaaaaaaaaauaacccaucauuggcauaggucuggaaguacaauagguaaagcauucgaagcaacaguaagaggagcuagaagaauggcuguauugggagauacugcgugggacuuuggaucaguagggggagcccuuaauucacuaggaaaaggaauacaucaaauuuuuggagcagcauucaaaucacuauuuggagguaugucaugguuuagccaaauucuaauaggaacauuauuaauguggcuuggauuaaacacaaaaaauggaaguauuucacuaaugugccuagcacucgguggaguguuaaucuuuuuaucaacagcaguaucugcg

SEQ ID NO: 2693 - RNA, 2061 nt, Artificial Sequence
  KX806557.2 prME-short CDS opt
acuucaguagguauaguaggauuacuuuuaacuaccgcgauggcagcagaaguaacaagaagagggucagcuuauuacauguacuuagacagaaaugaugcaggagaagcaaucaguuucccaacuacauuagguaugaacaaauguuacauccaaauuauggauuuaggacauaugugugacgcaacaauguccuacgaauguccaauguuagaugaaggaguugaacccgaugacgucgacuguuggugcaauacaacaaguacuuggguagucuaugggacaugccaucauaagaaaggagaagcgagaagaagucgacgagcaguaacacuaccaucucauaguacaagaaaauuacaaacacgaagucaaacauggcuagaaucuagagaauauacaaaacaucuaaucagaguagaaaauuggauguuucgaaauccuggauuugcacuagccgcagcagcaauagcauggcuauuaggaucaucaacaucacaaaaaguaauuuacuuaguaaugauuuuguuaauagcuccugcauauaguauaagaugcauaggaguaucaaacagagauuuuguagaaggaaugucaggagguacauggguagauguaguuuuagaacauggcggauguguaacaguuauggcacaagauaaaccaacuguagauauagaauuaguaacaacuacaguaucuaacauggcugaaguuagaucguacuguuacgaagcaagcauuucugacauggcaucagauucuagauguccuacacaaggagaagcauaucuugauaaacagucagauacacaauacguauguaaaagaacauuaguagauaggggauggggaaauggaugcggucuauuugggaaaggaucguuaguuacaugugcaaaauucgcauguaguaagaaaaugacaggcaaaucaauacaacccgagaaccuugaauauagaauaauguuaagcguucauggaucccaacacagcggaaugauagucaacgauaccggucacgaaacugaugaaaaccgugcaaaaguagagauaacuccaaacucaccacgugcagaagcaacauuaggagguuuuggcucucuaggacucgacugugaacccagaacuggucuagacuuuucagaucuauauuauuugacaaugaauaacaaacauuggcugguucauaaagaaugguuccaugauauaccauuaccauggcaugccggagcagauacaggaacuccgcacuggaacaauaaagaggcuuuaguagaauuuaaagaugcccaugcaaaacgacaaacaguaguuguauuaggaagucaagaaggugcaguucacacagcucuggcaggagcauuagaggcagaaauggacggcgcuaaagguagauuaucauccggacauuuaaaauguagauuaaaaauggauaaauuaagauuaaaagguguaagcuauagccuaugcacugcugcauuuacauucacaaaaauaccagcagaaacauuacauggaacaguuacgguugaaguucaauaugcagguacugacggaccauguaagguaccugcacaaauggcaguggauaugcaaacauugacucccguugguagguuaauaacagcaaauccagucauaacugaaucaacagaaaauucaaaaaugaugcuagaauuagauccuccauuuggagacaguuacauaguaauaggaguaggugaaaagaaaauaacacaucauuggcacagaagcggaaguacuaucggaaaagccuuugaagccacgguuagaggugcaaaaagaauggcgguauugggagauacagcaugggacuucggcaguguaggaggagcuuuaaauucauuaggaaaaggaauacaccaaauauucggagcugcauuuaaaagccucuucggagguaugucaugguuuucccaaauucuaauaggaacacuacuaaugugguuaggacuaaauacuaaaaauggaucaauaucacuaaugugcuuagcacucggaggaguacuaaucuuccuaucaacagcaguaagugca

SEQ ID NO: 2694 - RNA, 2061 nt, Artificial Sequence
  LC191864.1 prME-short CDS opt
acaaguguagguauaguaggacuauuauuaacaacagcuauggcagcagaaguaacgcggagagggucagcguauuauauguaucucgauagaaacgaugccggagaagcaauaagcuuuccaacaacauugggaaugaauaaauguuauauacaaauaauggauuuaggacauaugugugaugcaaccaugucauacgagugcccaauguuagaugaagguguagaaccagaugauguugauuguuggugcaacaugacaaguacauggguagucuauggaacaugucaucacaaaaaaggagaagcaagaagaucaagaagagcaguaacacuacccucccauucaacgagaaaacuucaaacaaggagucaaacaugguuagaaucccgagaauacacaaaacaucuaauaagaguagaaaauuggauauuucgaaauccagguuuugcucuagcugcagcagcgauagcaugguuacuuggaagcucuaccucacaaaaaguaauauauuuaguuaugauucuacuaauagcaccagcauauucaauaagaugcauaggaguaucaaaucgagauuuugucgaaggaaugucaggaggaacauggguagauguuguccuagaacauggaggguguguuacuguaauggcacaagauaaaccuacaguagacauagaacuuguaacaacaacaguaucaaauauggcugaaguucguucauauuguuaugaagcuaguauaagcgacauggccagcgauucaagauguccaacacaaggagaagcauacuuagauaaacaaagugauacacaauauguaugcaaacgaacucuuguugauagaggaugggguaaugguugcggauuauuuggaaaaggaucacuuguaacaugugcaaaauuugcauguaguaagaaaaugacgggcaaaucaauacaacccgaaaauuuggaauauagaauaauguuaaguguucauggaagccaacacucaggaaugauaguaaaugauacaggacaugaaacagaugaaaaucgagcaaaaguagaaauaaccccuaacagcccacgagcagaagcaacguuaggaggauuuggaucacuaggccuagauugugaaccacgaacuggacuugacuuuagcgauuuauacuaccugacuaugaacaacaaacacugguuaguacauaaagaaugguuucaugacauaccacuuccuuggcaugcaggugcagauacaggaacaccacauuggaauaauaaagaagcuuuaguagaauuuaaagaugcgcaugcaaaacgccaaacaguuguaguauuaggcucccaagaaggagcgguacauaccgcccucgcaggagcauuagaagcagaaauggauggagccaaagguagauuaucaucuggccauuuaaaauguagguuaaaaauggacaaauuacgauuaaaagguguaaguuauucauuaugcacagcugcauucacauucacaaaaauuccagcagaaacauuacacggaacaguaacaguugaaguucaauacgcgggaaccgacggaccauguaagguaccagcccaaauggccguagacaugcaaacauuaacaccaguaggaagauuaauaacagcuaauccaguaauaaccgaaagcacagaaaauucaaaaaugauguuagaauuagauccuccauuuggagauucguauaucgugauugggguaggagaaaaaaaaauuacacaccacuggcauagaucaggcucaaccauaggaaaagcauuugaagcuacuguaagaggugcuaaaagaauggcaguucucggugacaccgcaugggacuuuggaaguguagguggugcauuaaauucauuaggaaaaggaauccaccaaauauuuggagcagcauuuaaaucguuauucggaggcaugucaugguuuagucaaauauuaauagguacuuuauuaaugugguuaggacuaaauacaaaaaaugguaguauaaguuuaauguguuuagcucuaggaggaguauugauauucuuaucaacugcaguuagcgcu

SEQ ID NO: 2695 - RNA, 2061 nt, Artificial Sequence
  KU744693.1 prME-short CDS opt
accagcguaggaauaguuggucuauuacuaacaacagcuauggcagcagaaguaacaagaaggggaucagcauauuauauguauuuagaucgaaaugaugcuggagaagccauaucuuuucccacaacacuaggaaugaacaaaugcuauauacaaauuauggauuuaggucauaugugugaugcaacaaugucauacgaauguccuauguuagaugaaggaguagaaccggaugauguagauuguugguguaauacaaccucaacauggguagucuacgguacuugucaucauaaaaaaggugaagcaagaaggaguaggagagcgguaacuuuaccaucgcauucaacaaggaaacuucaaacaagaagucaaacauggcuagaaaguagagaauauacaaaacaucucauaagaguugaaaacuggauauucagaaauccuggcuuugcuuuggcugcagcagcaauagcgugguuacuagggucaucaacaucgcaaaaaguuauauaccugguuaugauauuauuaauagcaccggcauauaguauuagauguauaggaguaucaaauagagauuuuguugaaggaaugagcggcggaacauggguagacguuguucuagaacauggaggaugcguaacagcuauggcucaagauaaaccgacaguagacauagaauuaguaacaacuacaguuagcaauauggcugaagucaggucauacuguuacgaagccagcauaagugauauggcuagcgacaguagaugucccacucaaggagaagcauaucuagauaaacaaagcgauacacaauauguguguaaacguacauuaguagacagaggauggggcaauggaugcggauuauuuggaaaagguagucuaguaacaugugcaaaauuugccugcagcaaaaaaaugacaggaaaaaguauacaaccagaaaacuuagaauaccgaauaauguuaucaguacaugguagucaacacaguggaauguuaguaaacgauacaggucaugaaacagaugaaaaucgugcaaaaguagaaauaacaccaaauucgccaagggcagaagcaacucuaggaggauuuggaucacuagguuuggauugugaaccaaggacaggacuagauuuuucagauuuauauuaucuaacuaugaauaauaaacauugguuagcacauaaagaaugguuucacgauauaccauuaccauggcacgcgggagcagcaacuggcacaccacauuggaauaauaaagaagcauuaguagaauucaaagaugcacacgcaaaaaggcaaacuguaguaguacuaggcucacaagaaggagccguacauaccgccuuagcaggagcauuagaagcugaaauggauggagcaaaaggaagauuaucuucuggacaucuaaaaugucgauuaaaaauggauaaacuaagauugaaaggaguaagcuacuccuuguguacagcugcauuuacauuuacaaagaucccagcugaaacaguugauggaacuguaacuguagaaggacaguauggaggaacagaugggccuuguaaaguuccagcacaaauggccguagauaugcaaacguuaacuccuguuggaagacuaauaacagcaaauccgguaaucacagaaagcacagaaaauagcaaaaugauguuagaauuagacccaccuuuuggagauucauauauaguaauugguguaggagaaaaaaaaauaacacaccacuggcauagaucuggaaguacaauaggaaaagcauuugaagcaaccguaaggggagcgaaaagaauggcaguucuaggcgauacagccugggacuuuggaagcgucggaggcgcauuaaauaguuuaggaaaaggaauacaucaaauuauaggagcugccuucaaaucauuauucggaggcaugucuugguuuagucagauauuaaucgguacauuacuaaugugguuaggauuaaauacaaaaaacgguagcauaucauuaaugugucuagcguuaggaggaguuuuaauuuuucuaaguacagcaguaucaggg

SEQ ID NO: 2696 - RNA, 2052 nt, Artificial Sequence
  KU963574.2 prME-short CDS opt
ggggcagacgcuucuauaggaauaguaagccuauuauuaacuacuguuauggcagcagaaauaacaagaagggguagugccuauuauauguauuuagacagaagugaugcaggaaaagcaauaaguuuugucacaacuuuaggaguaaauaaaugucacguucaaauaauggauuuaggacauaugugcgaugcgacaaugaguuaugaauguccuauguuagaugaaggcguagaaccagaugacguagauuguugguguaauaccacaucaacuuggguuguauauggaacuugucaucacaaaaaaggagaagcgagaagaucaaggagagcaguaacauuaccaagucauucaacaagaaaacuucaaacaagaagccaaacaugguuagaaaguagagaguacacuaaacaucuaauaaaaguagaaaauuggauauuuagaaauccagguuuugcacuaguugcagucgcuauagccuggcuacuaggaucaucuacaagccaaaaaguaaucuaucuaguaaugaucuuacuaauagcaccagcauauaguauaagauguauuggaguaagcaauagagauuuuguagaaggaaugagcggaggaacuuggguugacguaguauuagaacauggcgguugcguuacagucauggcacaagauaaaccaacaguagauauugaacuagugacaacaacagugagcaauauggcagaaguaagaucguauuguuaugaagcaucaauaucugauauggcuucugauagcagaugccccacacaaggugaagcauauuuagacaaacaaagugacacacaauauguauguaaaagaacauuaguagacagaggauggggaaacggauguggauuguuuggaaaagguaguuuaguuacaugugcaaaauucacuuguucaaaaaaaaugacaggaaaaucuauccaaccagaaaauuuagaauacagaauuaugcuaaguguucauggaagucaacacucgggaaugauagucaaugacgaaaacagggccaaaguugaaguuacgccaaacucaccuagagcagaagccacacuaggaggauuuggaucacuaggacuugacugugaacccagaacgggacuagauuuuagugauuuauauuaucuuacaaugaauaacaaacauuggcuaguacacaaagaaugguuucaugacauaccacuacccuggcacaguggugcagauaccgaaacaccacauuggaacaauaaagaagcacuaguagaauucaaagaugcacaugcaaagagacagaccgugguuguacuagggagccaggaaggagcaguacacacggcauuagcgggagcauuagaagcagaaauggacggagcgaaaggaagauuaucaagcggacaucuaaaauguagauuaaaaauggauaaauugagauuaaaaggaguuucauacaguuuauguaccgcugcauuuacuuuuacuaaaguucccgcugaaacgcuacacggaacaguaacaguagaaguucaauaugccggaagagacggucccuguaaaguacccgcacaaauggccguagauaugcaaacacuaacaccggugggaagacuaauaaccgccaacccaguuauuacagaaucaacagagaauucaaaaaugauguuagaauuagaucccccauuuggugauucuuauauaguaauaggaguaggugauaaaaaaauaacccaccacuggcauaggagcggaucaauaauaggcaaagcauucgaagcaacaguccgaggagcaaaaagaauggcaguacuuggugauaccgcaugggacuuuggaaguguaggaggaguauuuaauagucuagguaaaggaauucaucaaauuuuuggagcggcuuuuaagucauuauucggaggaauguccugguucagucaaauccuaauaggaaccuugcuaguaugguuaggauuaaauacaaaaaauggcucaauuucauuaacaugucuagcacuuggcggaguaaugauauuuuuauccacugcaguaucggca

SEQ ID NO: 2697 - RNA, 2070 nt, Artificial Sequence
  KF383120.1 prME-short CDS opt
ggagccgacacuaguauaggaauaauaggauuauuauuaacuacagcaauggcggcugaaauaacucgaagaggaucagcauauuauauguauuuagauagaucagaugcuggaaaagcaauaaguuuugcaacaacaaugggaguaaacaaaugccauguacagauuauggaucuaggucacaugugugaugcuacaaugaguuaugaaugcccaauguuagaugagggaguagaaccagaugauguggauuguugguguaauacaacgucaacauggguuguauauggaacaugucaccacaaaaaaggagaagcaaggccgucaagacgagcaguaacauuaccuagucauaguaccagaaaacuacaaacuagaagccaaacaugguuagaaaguagagaauauacaaaacacuuaauaaaaguggaaaauuggauacuaaggaauccaggcuuuacuguagcggcauuagcuauggcauggcuacuugggaauucaacaucacaacgaguaauauauuuaguaaugauauuacuaauagcgccugcauauuccauaagaugcauuggaguaagcaaccgcgacuuuguagagggaaugucaggcggaacuuggguugauguaguauuagaacacgguggauguguaacuguaauggcacaagacaaaccuacaguagacauugaauuaguuacgacaacaguaagcaauauggcagaaguacguuccuauuguuaugaagcuaguauaucagauauggcaagcgauucuagauguccuacacagggagaagcauauuuagacaaacaaagugauacacaauacguaugcaaacgcacccuaguagaucgaggauggggaaacgggugcggauuauuugguaaaggaucauugguuacuugcgcgaaauuuacauguaguaaaaaaaugacaggaaaaucaauucaaccugaaaauuuagaauaucgaauaaugcugucaguacauggaucacaacauaguggcaugauagucaaugauauaggacaugaaacagaugaaaacagggccaaaguagaagucacccccaauucccccagagcagaagcgacauuaggcggcuuuggaaguuuaggauuagauugcgaacccagaacaggauuagauuuuucugauuuauauuaucuaacaaugaacaacaaacacugguuaguacacaaagaaugguuucacgacauaccccuaccguggcaugcaggagcagauaccggaacaccacauuggaauaauaaagaagcauuaguagaauuuaaagaugcucacgcaaaaagacaaacaguuguaguauuaggaucucaagaaggugcuguacauacagcacuugcaggagcauuagaagcagaaauggauggagcaaaaggaagauuauuuuccggacaccuuaaaugcagaauaaaaauggacaagcuaagauuaaagggaguaaguuauucacuauguacugcagcuuuuacauuuaguaaaguaccagcagaaacuuuacaugguaccguaacuguugaaguucaauaugcaggaagggaugggccaugcaaaguaccugcccaaauggcaguagauaugcaaacuuuaacgccuguagguagauuaauuaccgcaaauccuauuauuacagaaucaacugaaaauagccgcaugauguuagaacuagauccgccauuuggugauagcuauauaguuauaggaguaggagauaaaaaaauaacacaucauuggcauagaaguggaucaaccauaggcaaagcauuugaagcaacaguaagaggagcgaaaagaauggcaguacuaggcgauacugcaugggacuuuggaucaguagguggaguauucaauucauuaggaaaaggaguacaucaagucuuuggagcugcuuucaaaaguuuauuuggagggaugucaugguuuagccaaauauuaauugggacuuuauuaguuuggcugggauuaaauacaaaaaauggaaguauaucauuagcuugucuugcacuaggaggagcaaugauauuccuaagcacagcuguaucagca

SEQ ID NO: 2698 - RNA, 1353 nt, Artificial Sequence
  KU321639.1 solE CDS opt
ucacaaaaaguaauauauuuaguaaugauacuauuaauagcaccagcuuauagcauaagauguauaggaguuucaaacagggauuucgucgaaggaaugagugguggaacauggguagauauaguucuagaacauggagguuguguaacagugauggcacaagauaaaccaacuguagauauagaauuaguuacuacaaccguaucaaauauggcagaaguuagaucauauuguuaugaagcaucaauaagugauauggccucagauucaagauguccaacacagggggaagccuacuuagauaaacaaucagauacucaauauguauguaaaagaacauuaguagauagagguuggggaaauggauguggauuauuuggaaaagguaguuuaguaacgugugcaaaauucgcauguucuaaaaaaaugacaggaaaaaguauacaaccugaaaaccuagaauauagaauaaugcuaucaguacaugguagucaacauucgggaaugauaguaaaugauacaggacaugaaacagacgaaaauagagcaaaaguugaaauaaccccaaauaguccaagagcagaagcaacauuaggaggauuuggaucauuaggacuagauugcgaaccaagaacaggauuagauuuuagugauuuauauuaucuaacaaugaauaauaaacacugguuaguacauaaagaaugguuccaugauauaccacuaccauggcacgcaggugcagauacaggaacaccacauuggaauaauaaagaagcauuaguugaauucaaagacgcccaugcaaaaagacaaacaguaguaguacuugguagucaagaaggugcuguucacacagcauuggcaggagcauuagaagcagaaauggauggagcuaaaggaagauuaucaucaggacauuuaaaaugcagauuaaaaauggauaaacuaagacuaaaaggaguaaguuauagucuaugcacggcggcauuuacauucacuaaaauaccagcggaaacacuacaugggacaguaacaguagaaguacaauaugcaggaacagauggaccuuguaaaguuccagcucaaauggcaguagauaugcaaacauuaacaccgguagguagauuaauaacagcuaacccaguaauaacagaaaguacugaaaauucaaaaaugaugcuagaacuagauccaccauuuggagacucauauauaguaauaggaguaggagaaaaaaaaauaacucaucauuggcacagaucaggaaguacaauaggaaaggcauucgaagcaacaguaagaggagcuaaaagaauggcaguuuuaggagauacagcaugggauuuuggaagc

SEQ ID NO: 2699 - RNA, 1353 nt, Artificial Sequence
  KU312312.1 solE CDS opt
ucacaaaaaguaauauauuuaguaaugauacuacucauagcaccagcuuauaguauaagaugcauuggaguaucaaaucgagauuuuguagaagguaugucaggaggaacauggguagauguaguacuagaacaugguggauguguaacuguaauggcacaagacaaaccaacaguagacauagaauugguaacaacaacaguaaguaauauggcagaaguaagaucauauuguuaugaagcaagcauaucagauauggcaagugacagcagguguccaacucaaggugaagcauaccuagauaaacaaucagauacacaauauguuuguaaaagaacauuagucgacagagguuggggaaaugguugcggacuauucggaaaaggaagcuuaguaacaugugcaaaauuugcauguagcaaaaaaaugacagguaaaucaauucaaccagaaaauuuagaauacagaauaaugcuuaguguacacgguucccaacauaguggaaugaucguaaaugacaccggacaugaaacugaugaaaaucgugcaaaaguagaaauaacaccaaauuccccaagagcugaagcaacacuaggaggauucgguucauuaggauuagauugugaaccuagaacaggauuagauuuuucagaucuauauuaucuaacgaugaauaauaaacauugguuaguacauaaagaaugguuucaugauauaccauuacccuggcaugcuggagcagauacagggacaccacauuggaauaauaaagaagcguuaguugaauuuaaagacgcacaugcaaaaagacaaacaguaguaguacuuggaucacaagaaggcgcaguacauacagcacuagcaggagcacuggaagcugaaauggauggugcaaaggguagacuaucaagcggacaucuaaaauguagacuaaaaauggauaaacuaagacuaaaaggaguuuccuauaguuuguguacagcagcauuuacuuuuacaaaaauaccagcagaaacauuacauggaacaguaacaguagaaguucaauaugcaggaacggauggaccauguaaaguaccagcacaaauggcaguagacaugcaaacauuaacaccaguaggaagauuaauaaccgcuaauccaguaauaacagaaucaacagaaaauucaaaaaugaugcuugaacuugauccaccauuuggagauucauacauaguaauaggaguaggagaaaaaaaaauaacacaucacuggcacagaaguggaucaacaauaggaaaagcauuugaagcaacgguaagaggagcaaaaagaauggcaguauuaggagauacugccugggauuuuggaagc

SEQ ID NO: 2700 - RNA, 1341 nt, Artificial Sequence
  AY632535.2 solE CDS opt
ucucaaaaaguaauauauuuaguuaugauauuauuaauagcaccagcauauucaauaagauguauaggaguaucaaauagagacuuuguagaaggaaugaguggaggaacauggguagauguaguacuagaacauggaggauguguaacaguuauggcacaagauaaaccaacgguagacauagaauuaguaacaacuacaguaucaaauauggcagaaguaagaagcuacuguuaugaagcaucaauuagugacauggcaagugacagcagauguccaacacaaggagaagcauauuuagauaaacaaagugauacacaauacguaugcaaaagaacauuaguagacagaggauggggaaauggauguggauuguuuggcaaaggaaguuuaguaacaugugcgaaauuuacuuguaguaagaaaaugacagggaaaucaauacaaccagaaaauuuagaauauagaauaaugcuaaguguacaugguucacaacacucagggaugauugguuacgaaacggaugaagauagagcaaaaguagaaguuacaccaaauagccccagagcagaagcaacguuagguggcuuuggcaguuuaggauuagauugugaaccaagaacaggauuagacuuuagugaucuauauuauuuaacaaugaauaauaaacauugguuaguacacaaagaaugguuccaugauauaccucuaccauggcaugcaggagcagauacaggcacaccgcacuggaauaauaaagaagcauuaguagaauuuaaagaugcacaugcaaaacgacaaaccguagucguauuaggaagucaagaaggggcaguucacacagcauuagcaggagcucuugaagcagaaauggauggagcaaaaggaagauuauucucaggacacuuaaaauguagacuaaaaauggauaaauugagacucaaagguguaucauauagucuguguacagcagcauucacauuuacaaaaguaccugcagaaacauuacaugggacaguaacaguugaaguacaauaugcagguacugauggaccauguaaaaucccuguacaaauggcaguggauaugcaaacucuaacaccaguaggaagacuaauaacagcuaauccaguaauaacagaaagcacagaaaauagcaaaaugauguuagaauuagauccacccuucggagauaguuacauaguaauaggaguuggagauaagaaaauaacacaccacuggcauagaucaggcaguacaauaggaaaagcauuugaagcuacagugagaggugcuaaacgaauggcuguauuaggagauacagcuugggauuuuggaagu

SEQ ID NO: 2701 - RNA, 1353 nt, Artificial Sequence
  KU527068.1 solE CDS opt
agccaaaaaguuauauaucuaguuaugauacuauuaauagccccagcauauaguauaagguguauaggggugaguaacagagauuucguagaaggaaugucaggaggaacauggguagauguaguacuagaacacggaggauguguuacaguaauggcacaagauaaaccaacaguagauauagagcuaguaacgacaacaguaaguaauauggcagaaguucgaucuuauuguuaugaagcaaguauaagugauauggcaagugauucacguuguccaacacaaggagaagcauauuuagauaaacaaagugauacucaauauguuugcaaaagaacauuaguagauagaggauggggaaacgggugugguuuauuugguaaaggaaguuuaguaacaugcgcaaaauuugcauguagcaagaaaaugacuggaaaaaguauacaaccagaaaauuuagaauauagaauaaugcuaagcguacacgguagucaacauagugguaugauugucaaugauacuggacaugaaacagacgaaaauagagcuaaaguagaaauaacaccaaauagcccacgagcagaagcuacacucggaggauuugguucuuuaggauuggauugugaaccucgaaccggacuagauuuuagcgaucucuacuacuuaacaaugaauaauaaacauuggcuaguacauaaagaaugguuucaugauaucccauuaccauggcaugcaggagcagauacaggaacaccacauuggaacaauaaagaagcauugguagaauuuaaagacgcacaugcaaaaagacaaacuguaguaguacuaggaucacaagagggugcuguacauacagcgcuagcaggcgcacuagaagcagaaauggauggugcaaaagggcgauuaaguucaggacaucuaaaauguagauuaaaaauggauaaauuaagacuaaaaggaguaucauauucauuauguacugcugcauuuacauuuacaaaaauaccggcagaaacauuacauggaacaguaacaguagaaguacaauaugcaggaacagacggaccauguaaagucccagcacaaauggcaguugauaugcaaacauuaacaccuguaggaagauuaauaacagcaaauccaguaauaacagaaucaacagaaaacucaaaaaugauguuagaauuagauccuccauuuggugacagcuauauaguaauagguguaggagaaaagaaaauuacacaccauuggcauagaagcggaucaaccauaggaaaagcauuugaggcaacaguaagaggagcaaaaagaauggcaguauugggagacacagcaugggauuucggaagu

SEQ ID NO: 2702 - RNA, 1353 nt, Artificial Sequence
  KX421193.1 solE CDS opt
agccaaaaaguaauauauuuaguaaugauauuacuuauagcuccagcuuauaguauaagauguauaggggucucaaauagagacuuuguugaaggaaugaguggaggaacauggguagacguaguuuuagaacauggaggauguguaacuguaauggcacaagauaaaccgacaguagauauagaauuaguaacaacaaccguaaguaauauggcagaaguaagaagcuauugcuaugaagcaagcaucagugauauggcaagugauaguagauguccaacacaaggagaagcauaccuagacaaacaaagugacacacaauauguauguaaaagaacacuaguagauagaggauggggaaacggaugcggauuauuugguaaagguucauuaguaacaugugcaaaauuuacauguagcaaaaaaaugacaggaaaaagcauucaaccagaaaaucuagaauacagaaucaugcuaucuguacauggaucacaacacagugguaugauaguuaaugauacuggauaugaaacagaugaaaauagggcaaaaguggaaguaacuccaaauagcccaagagcagaagcuacauuaggaggauucggaaguuuaggacuagauugcgaaccaagaacaggacuagacuuuucagaucuauauuauuuaacuaugaauaauaaacauugguuaguacacaaagaaugguuucaugauauaccauuaccauggcacgcaggagcagauacuggaacaccccauuggaauaauaaagaagcacuaguagaauucaaagaugcucaugcaaaaagacaaacuguaguaguauuaggcucacaagaaggagccgugcauaccgcauuagcuggagcucuagaagcugaaauggauggagcaaaagggaaauuauucaguggacacuuaaaaugucgacuaaaaauggauaaguugaggcuaaaagguguaaguuauucauuauguacagcagcauucacauuuacuaaaguaccagcagaaacauugcauggaacgguaacaguggaaguccaauaugcaggaacggauggaccaugcaaaauaccaguacagauggcaguagauaugcagacauuaacaccaguaggaagacuaauaacagcgaauccaguaauaacagaaaguacagaaaauaguaaaaugauguuggaauuagauccccccuuuggagauucauacauaguaauaggaguaggagauaaaaaaauaacucaccauuggcauaggaguggaucaacaaucggaaaagcauuugaagcaacuguaagaggagcaaaaaggauggcaguacuaggagauacagcaugggauuuuggauca

SEQ ID NO: 2703 - RNA, 1353 nt, Artificial Sequence
  LC002520.1 solE CDS opt
agucaaaaagucauauauuuaguaaugauauuauuaauugcaccugcauauaguauaagauguauaggaguaaguaauagagacuuuguagaaggaaugagugguggaacauggguagacguagucuuagaacauggaggauguguaacuguaauggcacaagacaaaccaacaguugauauagaauuaguuaccacaacaguaaguaauauggcagaaguaaggaguuauuguuaugaagcaaguaucagugacauggcaagugauagucgauguccaacacaaggagaagcauaucuagauaaacaaucagauacacaauauguauguaaaagaacauuaguagauagaggaugggguaacgguuguggacuauuugguaaaggaagcuuaguaacuugugcaaaauucacauguucaaaaaaaaugacaggaaaaucaauacaaccagaaaaucuggaauacagaauaauguuaucaguacauggaagucaacauaguggaaugacaguaaacgauauaggauaugaaacagaugaaaauagagcaaaaguagaaguaacuccaaauagcccaagggcagaagcaacacuaggagguuuuggaucacugggauuagauugcgaaccaagaacuggacucgacuucagcgauuuauacuauuuaacuaugaauaauaaacauugguuaguucauaaagaaugguuucacgacaucccauuaccauggcacgcaggagcggauacagguacaccacacuggaacaauaaagaggccuuaguagaauuuaaagaugcacaugcaaaaaggcaaacuguaguaguauugggaagucaagagggagcaguacauacagcacuagcaggugcauuagaagcagaaauggacggagcaaaagguaaacuauuuucaggacaucuaaaaugcagauuaaaaauggacaaauuacguuuaaaaggaguaaguuacucacuuuguacagcggcuuuuacauucacaaaaguaccagcagaaacauuacauggcacaguuacaguagaaguacaauaugcaggaacagacggaccauguaaaauaccaguacaaauggcaguagacaugcaaacacuaaccccgguaggaagacuuauaacagcaaauccaguaauaacagaaaguacugaaaauucaaaaaugaugcuagaauuagauccuccauuuggagauucauacauaguaauagguguaggggauaaaaaaauuacacaccauuggcauagauccggaagcacaauaggaaaagcauuugaagcaacgguaagaggagcuaaaagaauggcuguacuaggagauacagccugggauuuuggauca

SEQ ID NO: 2704 - RNA, 1335 nt, Artificial Sequence
  DQ859059.1 solE CDS opt
ucgcaaaaaguuauauaucuaguaaugauauuauuaauagcaccagcuuauaguauaagauguauaggaguaucaaacagagauuuuguagaaggaaugagcggagggacauggguagacguaguauuagaacauggagguuguguaacaguaauggcacaagauaaaccaacggucgauauagaauugguaacgaccacgguaucaaauauggcagaaguaagaaguuauuguuaugaagcauccauaagcgauauggcaagcgauaguagauguccaacacaaggagaagcauaucuugauaaacaaucagauacccaauauguauguaaaagaacauuaguagauagaggauggggaaaugguuguggauuguucggaaaaggauccuuaguaacaugcgcaaaauuuacauguagcaaaaaaaugacuggaaaaaguauacaaccugaaaaucuagaauauagaauaauguuaucuguacauggaagucaacauucaggaaugauuguaaaugacgaaaauagagccaaaguagaagugacaccaaauagcccaagagcagaagcaacauuaggagguuuugguagcuuaggauuagacugugaaccacgaacagggcuggacuuuucagacuuauauuaucuaacuaugaauaauaaacauuggcucguacauaaagaaugguuucacgauauaccacuaccauggcaugcaggagcagauacaggcacaccacauuggaauaauaaagaagcauuaguagaauucaaagacgcacacgcaaaaagacaaacaguaguaguacuaggaucacaagaaggagcaguacauacagcuuuagcaggagcucuagaagcagaaauggauggagcaaaagguagacuauucagcggacauuuaaaauguagauuaaaaauggauaaacuaagguuaaaaggaguaaguuauaguuuauguacagcagcauuuacauuuacgaaaguaccagcagaaacauugcacggaacagugacaguugaaguacaauaugcgggaacagacggaccaugcaaaguaccagcacagauggccguagauaugcaaacauuaacaccaguaggucgacuaauaacugcaaauccaguuauuacagaaucuacagaaaauagcaaaaugaugcuagaguuagauccuccauucggagacaguuauauaguaauaggaguuggagauaaaaaaauaacacaucauuggcauagaaguggaaguacaauaggaaaagcauuugaagcaacaguaagaggagcuaaaagaauggcuguuuuaggagauacagcaugggacuuuggaagu

SEQ ID NO: 2705 - RNA, 1341 nt, Artificial Sequence
  KU963573.2 solE CDS opt
ucacaaaaaguaauauacuuaguuaugauacuauuaauagcaccugcuuacagcauacgaugcauugguguaagcaaucgugacuuuguagagggaaugagcgguggaacauggguagacguaguauuagaacacggaggauguguaacaguaauggcgcaagauaaaccaaccguagauauagaauuaguuacaacaacaguaucaaauauggcagaaguaagaucauauuguuaugaagcaagcauaucagauauggcaagugacagucgaugcccaacacaaggagaagcauauuuagauaaacaaagcgauacacaauacguauguaaaagaacauuaguagauaggggauggggcaacgguugcggauuauucggcaaaggaagccuaguuacaugugccaaauuuacauguaguaaaaaaaugacuggaaaaucaauacaaccugaaaauuuagaauauagaauuaugcuaaguguacacggaagccaacacucaggaaugauuggauacgaaacagaugaaaacagggcuaaaguagaagucacaccaaauucaccaagagcagaagcaacacuuggaggcuucgguucgcuaggacucgauugugaaccaagaacaggacuagacuuuucugacuuauauuaucuaacaaugaauaauaaacauuggcuaguacauaaagaaugguuccacgauauaccauugccauggcacgcaggugcagauacaggaacaccacauuggaauaacaaagaagcauuaguagaauuuaaagacgcccaugcuaaaagacaaacaguaguaguacuaggaagucaagagggugcaguccauacagcauuagcaggagcacuagaagcagaaauggauggggcuaaagguaaauuauuuaguggacauuuaaaauguagauuaaaaauggacaaauuaagauuaaaaggaguaaguuacagcuuauguacagcagccuucacauuuacaaaaguaccagcagaaacauuacauggaacaguuacaguagaaguacaauaugcaggaacagauggaccauguaaaauaccaguccaaauggcaguagauaugcaaacauuaacaccaguaggaagauuaauaacagcaaauccuguaauaacagaaaguacagaaaauagcaaaaugauguuagaacuagauccaccauuuggugacaguuauauagugauaggaguuggagacaaaaaaauaacacaucauuggcaucgaucaggaaguacaauuggaaaagcauucgaagcaacuguaagaggagcaaaaagaauggcugucuuaggggacacagcaugggauuucggcagu

SEQ ID NO: 2706 - RNA, 1353 nt, Artificial Sequence
  KY075939.1 solE CDS opt
ucucaaaaaguaauauauuuaguuaugauacuauugauagcucccgcauauagucuaagauguauaggaguaagcaauagagauuuuguagaaggaaugagcgguggaacauggguagauguaguauuagaacauggaggauguguaacaguuauggcacaagauaaaccaacaguagauauagaauuaguaacaacaacaguaucaaauauggcagaaguaagaucauauuguuaugaagcaaguauaagcgauauggcuucagauaguagaugcccaacccaaggagaagcauaccuagauaaacaaagugauacacaauacguauguaaaagaacguuaguagauagaggauggggaaauggaugcggauuauuuggaaaaggaagucuaguaacaugugcuaaauuugcauguucaaagaaaaugacaggaaaaucaauucaaccagaaaauuuagaauauagaauaauguuaagcguacaugguucacaacauaguggaaugaucguaaaugauacaggacaugaaacagaugaaaaucgagcuaaaguagaaauaacaccuaacaguccaagagcagaagcaacauuaggaggauuuggaaguuuaggauuggauugcgaaccaagaacagguuuagauuucucagauuuauauuaucuaacaaugaauaacaaacauugguugguacauaaagaaugguuucaugauauaccucuaccuuggcaugcaggagcagacacgggaacaccacacuggaauaauaaagaagcauuaguagaauuuaaagaugcucaugcaaaaagacaaacuguaguaguauuaggaagucaagaaggagcaguucauacagccuuagcaggagcauuagaagcagaaauggauggagcuaaaggaagauuaucaaguggacauuugaaaugcagauugaaaauggauaaauuaagauuaaaaggaguaucauauagucuauguacagcagcauuuacauuuacaaaaauaccagcggaaacacuacauggcacaguuacugucgaaguacaauaugcaggaacagacgguccauguaaaguaccagcacaaauggcagucgauaugcaaacauuaacaccagugggaagauuaauaacagcaaauccaguaauaacugaaucaacugaaaauucaaaaaugaugcuagaauuagauccacccuucggugauucguacauaguaauaggaguuggggaaaagaaaauaacacaucauuggcauagaucaggaaguacaauuggaaaagcauucgaagcuacuguuagaggcgcuaaaagaauggcaguauugggagauacagcaugggauuuuggaagu

SEQ ID NO: 2707 - RNA, 1353 nt, Artificial Sequence
  KX447516.1 solE CDS opt
agcaaaaaaguaauauaccuaguaaugauauuacuaauagcaccagcauacaguauacgauguauaggaguaaguaacagagauuuuguugaaggaaugucaggaggaacauggguugauguaguauuagaacacggcggauguguaacaguaauggcacaagauaaaccaacaguugauauagaauuaguaaccacaacaguuagcaauauggcugaaguaagaucauauuguuaugaagcaucaauaucagauauggcaagugauucaagauguccaacacaaggugaagcauaucuagacaaacaaucagauacacaauacguauguaaaagaacacuagucgauagaggauggggaaauggaugcgguuuauucggaaaagggucacuaguuacaugugccaaauuugcaugcagcaaaaaaaugacuggaaaaucaauucaaccagaaaaucuugaauauagaauaauguuaucaguacaugguucacaacauagcggaaugauuguuaacgacaccggacaugaaacagaugaaaaucgagcaaaaguagaaauaacuccaaacucaccaagagcugaagcaacauugggaggauucggaucauuaggacuagacugugaaccaagaaccggauuagauuuuucagacuuauauuauuuaacaaugaauaacaaacauugguuaguacacaaagaaugguuucacgacauaccacuaccauggcacgcaggagcugauacagguacaccacauuggaauaacaaagaagcucucguagaauuuaaagaugcacaugcaaaacgacaaacuguagucguauuaggaucucaagaaggagcuguacauacagcacuagcaggagcauuagaagcagaaauggauggagcuaaaggaagauuaagcucaggccaucucaaaugccgauuaaaaauggauaaauuaagauuaaaaggaguaucauauucauuauguacagcagcauucacauuuacaaaaauuccagcugaaacauuacaugguacuguaacaguagaaguacaauaugccgguacagaugguccauguaagguaccugcacaaauggcaguagauaugcaaacauuaacaccaguaggaagacuaauaacagcaaauccuguaauaacagaaaguacagaaaauucaaaaaugaugcuagaauuagacccaccguucggcgauaguuauauuguaauaggaguaggagaaaaaaaaauaacucaccauuggcauagaucaggcucaacaauaggaaaagcauuugaagcaacaguaagaggagcuaaaagaauggcuguucuaggagacacagcaugggauuuugguuca

SEQ ID NO: 2708 - RNA, 1353 nt, Artificial Sequence
  KX447515.1 solE CDS opt
agccaaaaaguaaucuauuuagucaugauauuauugauagccccagcauacucuauaagauguauaggaguaaguaauagagacuucgucgaaggaaugaguggaggaacauggguagauguaguucuagaacauggaggauguguaacaguaauggcucaagacaaacccacaguagauauagaauuaguaacaacaacaguaagcaauauggcagaaguacgaaguuauugcuaugaagcaucaauaucagauauggcaucagauucaagauguccaacccaaggagaagcuuaucucgauaaacaaucagauacacaauauguauguaaaagaacucuaguagauaggggauggggaaaugguugcggucuauuuggaaaaggaaguuuagucacaugugcaaaauuugcaugcaguaaaaaaaugacaggaaaaucuauacaaccagagaacuuagaauauagaauaauguugaguguacacgguagucaacauagugguaugauagucaaugauacaggacaugaaacagaugaaaauagagcaaagguagaaauaacgccaaauucaccaagagcagaagcaacauuaggaggauuuggaagcuuaggacuagacugugaaccacgaacgggauuagauuuuagugaccuauauuauuuaacaaugaauaacaaacauuggcugguucauaaagaaugguuucacgauauaccacuaccauggcaugcuggagcagauacagguacaccacacuggaacaauaaagaagcauuaguagaauuuaaagacgcucaugcaaaaagacaaacgguaguagucuuaggaucacaagaaggagcaguacacacagcauuagcgggagcacuagaagcagaaauggauggugcaaaaggaagauuaaguaguggacaucuaaaauguagauuaaaaauggauaaauuaagguuaaaaggaguaaguuauucauuauguacggcggcauuuacauuuacaaaaauaccugcagaaacguuacauggaacaguuacagucgaaguucaauaugcuggaacagauggacccuguaaaguuccagcacaaauggcgguagauaugcaaacauuaacaccaguuggaagauuaaucacagcaaauccaguaauaacagaaaguacagaaaauaguaaaaugaugcuugaauuagauccaccauucggagauagcuauauaguaauuggaguaggugaaaaaaaaauaacgcaucauugguauagaucaggaucaacaauaggaaaagcauuugaagcaacuguaaggggagcaaaacguauggcaguauugggagauacagccugggacuuuggaagu

SEQ ID NO: 2709 - RNA, 1353 nt, Artificial Sequence
  KU758874.1 solE CDS opt
ucacaaaaaguaauauaucuaguaaugauauuacuuauagcuccugcauauaguauacgaugcauaggggugucaaauagagauuuuguagaaggaaugagugggggaacauggguagauguaguacuagaacacggagguuguguaacagucauggcacaagauaaaccgacuguggauauagaacuuguaacaacuacaguaucaaauauggcagaaguaagaaguuauugcuacgaagcaaguauaagcgacauggcaagcgauuccagguguccaacacaaggagaagcauaccuagauaaacaaagcgauacucaauauguauguaaaagaacgcucguagauagaggcuggggaaauggauguggauuauuugguaaagggaguuuaguuacaugugcuaaauuugcaugcaguaagaaaaugacaggaaaaaguauacaaccagaaaauuuagaauaucgaauaauguugucaguucauggaagucaacauucaggaaugauaguaaaugauacaggacaugaaacagaugaaaauagagcgaaaguugaaauaacaccaaauucaccaagagcagaagcaacacuagggggauuugggucacuaggacuagauugugaaccaagaacaggauuagauuuuucagaucucuacuaccuaacaaugaacaauaaacacugguuaguacauaaagaaugguuucacgacaucccauuaccauggcaugcaggagcagauacaggaacgccacauuggaauaacaaagaagcauuaguagaauuuaaagaugcccaugcuaaaagacaaacaguuguaguacuugguucacaagaaggugcaguacacacagcauuagcaggagcauuagaagcagaaauggauggagcaaaaggaaaacuaagcucuggacaucuaaaaugcagacuaaaaauggauaaauuaagauuaaaaggaguaagcuauagucuaugcacagcagcauucacuuucacaaaaauaccagcagaaacauuacacggaacaguaacgguagaaguacaauaugcaggaacugacggaccauguaaagugccagcacaaauggcaguagauaugcagacauuaacaccaguagguagauuaauaacagcaaacccggugauuacugaaagcacugaaaauaguaaaaugauguuagaacuagauccaccuuuuggagauaguuauauaguuauaggaguaggagaaaagaaaauaacacaccacuggcacagaucaggaucaacaauaggaaaagcauuugaagcaacaguaagaggagcaaaaagaauggcuguacuaggagauacagcaugggacuuugguagu

SEQ ID NO: 2710 - RNA, 1353 nt, Artificial Sequence
  KU729218.1 solE CDS opt
ucacaaaaaguaauauauuuaguaaugauacuccucaucgcaccagcauacucaauaagauguauaggaguaucaaacagagacuuuguagaaggaauguccggaggaacuuggguugauguuguauuagaacauggaggauguguaaccguaauggcacaagacaaaccaacaguagauauugaacuaguaacaacaacaguaucaaauauggcagaaguuagaaguuauuguuacgaagcaucaauaucagauauggcaucagauucaaggugcccaacacaaggagaagcauauuuagacaaacaaucagacacacaauauguaugcaaaagaacacuggucgauagaggauggggaaacggauguggauuguucggaaaaggaucauuaguuaccugugcaaaauucgcaugcagcaaaaaaaugacaggaaaaaguauacaaccagaaaauuuagaauacagaauaauguuaaguguucacggaucacaacauaguggaaugauuguuaacgacacaggacacgaaacagaugaaaauagagcaaaaguagaaauaacgccaaauucgccaagagcagaagcaacauuagguggauuuggaagcuuagguuuagauugugaaccaagaacaggacuugauuuuagcgauuuauacuaccuaacaaugaauaauaaacauugguuaguucacaaagaaugguuucaugauauaccauuaccauggcacgcaggagcagauacaggaacaccacacuggaauaacaaagaagcacuugucgaauuuaaagaugcgcacgcaaaaagacaaacaguaguuguucuaggaucacaagaaggagcaguacauacagcucuagcuggagcacuagaagcagaaauggacggagcaaaaggcagauuauccaguggacauuuaaaauguagacuaaaaauggacaaauuaagacuuaaaggaguuaguuauucacuauguacagccgcauucacauucacaaaaauuccagcagaaacacuacauggaacaguaacagucgaaguacaauaugcaggaacagauggaccauguaaaguaccggcacaaauggcuguagacacucagacauuaacaccaguaggaagguuaauuacagcaaauccaguaauaacugaaucaacagaaaauagcaaaaugauguuagaauuagauccaccauuuggugauaguuauauuguuauaggaguaggagaaaaaaaaauaacacaucauuggcaucgaucaggaagcacaauaggaaaagcauuugaagccacuguaagaggagcaaaaagaauggcaguacucggugauacagcgugggacuuuggaagc

SEQ ID NO: 2711 - RNA, 1353 nt, Artificial Sequence
  KU501217.1 solE CDS opt
ucacaaaaaguaauauaccuaguaaugauauuauuaauagcuccagcauauaguauaagaugcauaggaguaaguaaucgagauuuuguagagggaaugagcggggguacauggguagacguaguauuggaacacggaggauguguaacaguaauggcacaagacaaaccaacaguagacauugaacugguuacgaccacuguaucaaauauggcagaaauaagaucauacugcuaugaagcgaguauaagugauauggcaucagauucuagauguccaacacaaggagaagcauaucuagacaaacaaagugauacacaguauguauguaaaagaacgcuaguagauagaggauggggaaauggauguggucuauuugggaaagguagcuuaguaacaugugcaaaauuugcaugcaguaaaaaaaugacaggaaaaucaauucaaccagaaaauuuagaauauagaauaauguuaucugugcauggaucacaacauucaggaaugauagugaacgauacaggacacgaaacugaugaaaauagagcaaaagucgaaauaaccccaaauucacccagagccgaagcaacauuaggaggauuuggaucacuaggccuugauugugaaccaagaacaggauuagacuuuucagacuuguauuaucuaacaaugaauaacaaacauugguuaguacauaaagaaugguuucaugauauaccauuaccuuggcaugcaggagcagauacggguacaccacauuggaauaauaaagaagcccucguagaauuuaaagaugcacaugcuaaaaggcaaacuguuguaguacuagguagucaagaaggagcuguacauacagcauuagcaggagcauuagaagcagaaauggacggggcaaaagguaggcucaguucaggacaccuaaaaugcagauuaaaaauggauaaauuaagacuaaaaggcguaaguuauaguuuauguacagcagcauuuacauucacaaaaauaccagcagaaacguuacauggaacaguaacaguagaaguacaauaugcaggaacagauggaccuugcaaaguuccagcacaaauggcaguagauaugcaaacacuaacaccaguaggaagacuaauaaccgcaaauccaguaauaacagagagcacagaaaauagcaaaaugaugcuagaauuagacccaccauucggagauuccuauauaguaauaggaguaggugaaaaaaaaauuacacaucacuggcaccgaucaggaucaacaauagguaaggcuuucgaagcaacaguaagaggagcuaaacguauggcaguauuaggagauacugcaugggauuuuggauca

SEQ ID NO: 2712 - RNA, 1353 nt, Artificial Sequence
  KU761561.1 solE CDS opt
ucacaaaaaguaauauacuuaguuaugauuuuguuaauagcaccagcauauucaauaagaugcauuggaguaucaaauagagauuucguagaaggaaugagcggaggcacauggguagauguaguauuagaacaugguggauguguuacuguaauggcacaagauaaaccaacuguagacauagaacuaguaacaacaacaguaucaaauauggcagaaguaagaaguuauuguuaugaagcaagcauauccgauauggccucagacaguagauguccaacacaaggagaagcuuacuuagauaaacaaucagauacacaauauguauguaaaagaacacuaguagacagaggauggggaaauggaugcgguuuauucggaaaaggaagucuaguaacaugcgcaaaauuugcauguaguaaaaaaaugacaggaaaaaguauacaaccagaaaauuuagaauacagaauaaugcuaaguguccauggaagucaacauaguggaaugauuguaaaugacacaggacaugaaacagaugaaaauagagcgaaaguagaaauaacaccaaacucaccaagagcagaagcaacauuaggaggauuuggaucauuaggucuugauugugaaccaagaacuggacuugauuuuucagauuuauauuaccuaacaaugaauaauaaacacuggcugguacauaaagaaugguuccaugacauaccucuacccuggcacgcaggagcagauacagguaccccacauuggaauaauaaagaagcauuaguagaguucaaagaugcacaugcaaaaagacaaacaguaguuguauuaggaucacaagaaggagcaguacauacagcacuagcaggagcauuagaagcagaaauggacggcgcaaaaggcagacuuagcaguggacaccuaaaaugccgcuuaaaaauggauaaacuaagauuaaaaggaguaaguuauucauugugcacagcagcauucacauucacaaaaauacccgcagaaacacuacacgguacaguuacaguugaaguacaauaugcaggaacagauggaccauguaaaguuccagcacaaauggcaguagauaugcaaacauuaacaccaguaggucgauuaauaacagcaaacccaguaauuacagaaucaacagaaaauaguaaaaugauguuagaacucgaccccccauucggagacucauacauaguuauaggaguaggugaaaaaaaaauuacacaucacuggcacagaucaggaucaacaauaggaaaagcuuuugaagcaacaguuagaggagcacgaagaauggcuguauuaggagauaccgcgugggacuuuggaagu

SEQ ID NO: 2713 - RNA, 1353 nt, Artificial Sequence
  KY075937.1 solE CDS opt
ucucaaaaaguuauauauuuaguaaugauuuuauuaauagcaccagcauauucaauuagauguauaggaguaucaaauagagauuuuguagagggaaugucuggaggaacauggguagauguaguucuagaacauggaggauguguaaccguaauggcgcaagauaaaccaacugucgauauagaauuaguaacaacaaccguuucaaauauggcagaaguaagaucauauuguuaugaagcaucaauaagugauaugguaagcgacucaagauguccaacacaaggagaagcauaucuggauaaacaaucggacacgcaauauguauguaaaaggacucuaguugauagaggauggggaaauggaugcgguuuauuugguaaaggaaguuuaguaacaugcgcaaaauuugcauguucaaaaaaaaugacaggaaaauccauacaaccugaaaauuuagaauacagaauaauguuaucaguacauggaagucaacauucaggaaugauaguaaacgacacaggacaugaaacagaugaaaacagagcuaaaguggaaauaacaccgaauagcccaagagcagaggcaacauuaggaggauuuggaucacugggauuagauugugaaccaagaacaggcuuagauuuuagcgacuuauacuauuuaacaaugaauaauaaacauuggcuagugcauaaagaaugguuccacgauauaccauuaccguggcaugcaggagcagauacaggaacaccacauuggaauaacaaagaagcuuuaguagaauuuaaagacgcccaugcaaaaagacaaacgguaguaguauugggaucacaagaaggugcaguacauacagcacuagcaggagcauuagaagcagaaauggauggcgcaaaaggaagacuaucgucaggacacuuaaaauguagauuaaagauggacaaacuuagauuaaaaggcguaaguuauucauugugcacagcagcauuuacauuuacaaaaauaccugcagaaacauuacauggaacaguaacuguagaaguacaauaugcaggaacagacgguccaugcaaaguaccagcacaaauggcaguagauaugcaaacacuaacaccaguaggaagacuaauaaccgcaaauccagucauaacagaaucaacagaaaauagcaaaaugaugcuagaauuagauccuccauucggagauagcuauauagucauagggguuggggaaaaaaaaauuacucaccacuggcauagaaguggaagcaccauaggaaaagcauuugaagcaacaguaagaggagccaaaagaauggcaguguuaggagauacggcaugggauuuuggauca

SEQ ID NO: 2714 - RNA, 1353 nt, Artificial Sequence
  KY014317.1 solE CDS opt
agucaaaaaguaauauaccuaguaaugauacuauuaauagcaccugcauauaguauaagauguauaggaguaucaaauagagauuucguagaaggaaugucaggaggcacauggguagacguaguuuuagaacauggaggauguguaacuguaauggcacaagauaaaccuacuguagauauagaauuaguaacaacaacaguaucaaacauggcagaaguaagaaguuauuguuaugaagcaagcauaucugauauggcaucagacucaagaugcccuacacaaggagaagcguacuuagacaaacaaagcgauacacaauauguauguaaaagaacacucguagauagaggaugggggaacggaugugguuuauucgggaaaggaucccuaguaacaugugcaaaauuugcauguaguaaaaaaaugacagggaaaucaauacaaccugaaaaccuagaauauagaauaauguuaagcguacauggaucacaacauucaggaaugauuguaaacgacacaggacaugaaacagaugaaaauagagcaaaaguagaaauuacaccaaauucaccaagggcugaagcaacauuaggagguuuuggaaguuuaggauuagauugugaaccaagaacaggacuagauuucagugauuuguacuacuuaacaaugaauaauaaacauuggcuuguucauaaagaaugguuccaugauauaccacuaccauggcacgcaggagcagauacuggaacaccucacuggaacaauaaagaagcacuaguugaauucaaagacgcccaugcaaaacgacaaacugucguaguauuaggaucacaagaaggagcaguacauacagcauuagcaggagcauuagaagccgaaauggauggagcuaaaggaagauuaucaucaggacaucuaaaguguaggcuaaaaauggacaaacuaagauuaaaaggagugaguuacaguuuauguacagccgcauuuacauuuacaaaaaucccagcagaaacacugcauggaacuguaacaguugaaguacaauaugcaggaacagaugggccaugcaaaguaccagcacaaauggcaguagauaugcaaacacuaacaccaguaggaagguuaauaacagcuaauccaguaauaacagaaaguauagaaaauaguaaaaugauguuagaacuagacccaccuuucggugauucuuauauaguaauaggaguaggugaaaaaaaaauaacacaucauuggcauagaucuggaaguaccauaggaaaagcauuugaagcuacaguaagaggagcuaaaagaauggcaguauuaggagauacagcaugggauuucgguagu

SEQ ID NO: 2715 - RNA, 1353 nt, Artificial Sequence
  KU870645.1 solE CDS opt
ucacaaaaaguaauauaccuaguaaugauauuacuaauagcaccagcuuacucaauaagauguauagggguaucaaauagagauuuugucgaaggaaugucuggaggaacauggguagaugucguacuugaacacggaggauguguaacaguaauggcacaagauaaaccaacaguagauauagaauuaguuacaacaacaguaucaaacauggcugaaguaagaucauacuguuacgaagccucaauuucagauauggcaagugauucuagguguccaacgcaaggagaagccuauuuagauaaacaauccgauacacaauauguuuguaaaagaacuuuaguagauagaggaugggguaacggauguggauuauucggaaaagggucucuaguaacaugugcaaaauuugcauguaguaaaaaaaugacaggaaaaucaauacaaccugaaaaucuagaauacagaauaauguuaaguguacauggaagccaacauucaggaaugauaguaaaugauacaggacaugaaacagaugaaaaccgugccaaaguagaaauaacaccaaacucaccacgagcagaagcaacuuuaggaggauuugggucacuaggacuagacugugaaccaagaacuggacuugacuuuucugaucuauauuauuuaaccaugaauaacaaacacuggcuuguacacaaagaaugguuccaugauaucccauuaccauggcacgcaggagcagauacaggaacaccccauuggaauaauaaagaagcauuaguagaauuuaaagaugcacacgcaaaacgacaaacagucguuguauuaggaucacaagaaggagcaguacauacagcacuagcaggagcacuagaagcagaaauggauggagcaaaaggaagauuaucaagcggacaccuaaaauguagacuaaaaauggauaaauuaagauuaaaaggaguaaguuauaguuuauguacagcagcauucacauucacaaaaauaccagcagaaacacuacauggaacagucacaguagaaguacaauaugcuggaacagauggaccuuguaaaguaccagcacaaauggcaguagauaugcaaacauuaacuccaguaggaagauuaauuacagcaaauccuguaauaacagaaucaaccgaaaacucaaaaaugauguuagaauuagacccaccauuuggagacucauauauagucauaggaauaggcgaaaaaaaaauaacacaucacuggcacagaaguggcucaacaauaggaaaagcauuugaagcgacaguaaggggagcaaaaagaauggccguauuaggagacaccgcaugggacuuuggaagc

SEQ ID NO: 2716 - RNA, 1353 nt, Artificial Sequence
  KU922923.1 solE CDS opt
ucgcaaaaaguaauauaucugguuaugauuuuguuaauagcauuagcauacucaauaagaugcauaggaguaaguaauagggauuuuguagaaggaaugaguggagguacauggguagauguaguauuagaacaugguggaugcguaacaguaauggcacaagauaaaccuacaguagacauagaauuaguaaccaccacaguuucaaacauggcagaagucagaucauacuguuacgaagcaagcauauccgauauggcaucagacucuagauguccaacccaaggugaagcauauuuagacaaacaaucagacacacaauauguauguaaacgaacuuuaguagauagaggauggggaaaugguugcggauuauuuggaaaaggaucauuaguaacaugugcaaaauucgcaugcaguaaaaaaaugacuggaaaaucaauacaacccgaaaauuuagaauauagaauaauguuaaguguucauggcagucaacauagugguaugauaguaaaugacacaggacaugaaacagaugaaaacagagcaaaaguugaaauaacaccaaacucuccaagagcagaagcaacauuaggagguuuugguaguuuaggacuagauugugaaccaagaacuggauuagauuuuucagaucuauauuauuugacaaugaauaauaaacauugguuaguucacaaagaaugguuccaugauauaccacuaccauggcaugcaggagcagauacaggaacaccacauuggaauaauaaagaagcauuaguggaauuuaaagaugcacaugcaaaacgacaaacaguaguuguacuaggaucacaagaaggagcaguacacacggcauuagcaggagcauuagaagcagaaauggauggggcaaaaggaagguuaagcuccgggcauuuaaaaugccgauuaaaaauggacaaauuaagauuaaaaggugugucuuauagucuauguacagcagcauuuacauuuacaaaaauaccggcagaaacacuucaugguacaguaacaguagaaguacaauaugcaggaacagauggcccauguaaagugccagcacaaauggcaguagacaugcaaacacuaacaccagucggaagauuaauaacugcaaauccaguaauaacagaaucaacagaaaacaguaaaaugauguuagaauuagacccuccguucggagacuccuauauaguaauaggaguaggugaaaaaaaaauaacacaucauuggcauagaucaggaucaacaauaggaaaagccuuugaagcaacaguaagaggagcaaaaagaauggcaguacuaggagacacagcaugggacuuuggaucc

SEQ ID NO: 2717 - RNA, 1353 nt, Artificial Sequence
  KU497555.1 solE CDS opt
ucacaaaaaguaauuuacuuaguuaugauacuacuuauagcaccagcauauucaauaagauguauaggaguaucaaauagggacuuuguagaaggaaugaguggugguacuuggguagacguaguauuagaacacggaggauguguaacuguaauggcgcaagauaaaccaacaguagacauagaauuaguuacaaccaccguaaguaauauggcagaaguaagaaguuauugcuacgaagcaaguauaucagacauggcaagugauucaagauguccaacucaaggugaagcauauuuagauaaacaaucagauacacaauauguauguaaaagaacucuaguagacagaggaugggguaauggaugcggcuuauucggaaaaggauccuuaguuacaugugcuaaauuugcuuguaguaagaaaaugacaggaaaaaguauucaaccagaaaacuuagaauacagaauaauguugagcguacaugguagucagcauucaggaaugauagucaaugauacaggacaugaaacagaugaaaauagagcaaaaguagaaauaacaccaaauaguccaagagcagaagcgacauuaggaggauuuggaagccuaggacuagacugugaaccaagaaccgguuuagauuucuccgauuuauacuauuuaacaaugaacaacaaacacuggcuaguccauaaagaaugguuucaugauauuccacuaccauggcaugcaggagcagacacggguacaccacacuggaauaauaaagaagcauuaguagaauuuaaagaugcacaugcaaagagacagacaguaguuguauuaggaacacaagaaggugcaguacacacagcacuagcuggugcacuagaagcagaaauggauggagcaaaaggccgacuaaguaguggacaccuuaaauguagauuaaaaauggauaaauuaagauuaaaaggaguuucuuauaguuuauguacagcagcauucacauuuacaaaaauaccagcugaaacauuacacggaacaguaacaguugaaguucaauaugcaggaacagauggaccauguaaaguaccugcgcaaauggcuguagauaugcaaacguuaacaccaguaggaagauuaauaacugcaaacccaguuauaacagaaucuacagaaaauaguaaaaugauguuagaauuagacccuccauuuggcgauaguuauauaguaauaggaguaggagaaaagaaaauaacacaccacuggcauagaucaggaaguacaauaggaaaagcauuugaagcuacaguacgaggcgcuaaaaggauggcuguauuaggugauacagcaugggauuuuggauca

SEQ ID NO: 2718 - RNA, 1353 nt, Artificial Sequence
  KU312314.1 solE CDS opt
agccaaaaaguuauauauuuaguuaugauacuauuaauagcaccagcuuacaguauaagauguauaggaguaaguaauagagauuuuguagaggguaugucaggaggaacauggguagacguaguauuagaacauggaggauguguaacaguaauggcacaagauaaaccaacaguagauauagaacuaguaacgacaacaguaucaaauauggcugaaguuaggucauauuguuaugaagcaaguauuagugacauggcaucagauagcagauguccaacacaaggagaagcauaucuagacaaacaaagugauacacaauauguaugcaaaagaaccuuaguagauagaggauggggaaacggcuguggucuauuuggaaaaggaucauuaguaacaugcgcaaaauuugcaugcaguaaaaaaaugacaggaaaaucaauacaacccgaaaaucuagaauauagaauaauguuaaguguacauggaucacaacacucgggcaugauaguaaaugauacaggacaugaaacagaugaaaauagagcgaaaguagaaauaacaccaaauaguccuagagccgaagcaacguuaggaggauuuggcucacuuggacuggauugugaaccaagaaccggacuagauuuuucagauuuauauuauuuaacaaugaacaauaaacauugguuaguacacaaagaaugguuucaugauauccccuuaccauggcacgcaggugcagauacaggaacaccacauuggaauaauaaagaggcauuaguagaauuuaaagacgcacaugcaaaaagacaaacaguaguaguauuaggaagucaagaaggagcaguacauacagcauuagcuggagcccuagaagcggaaauggacggagcaaaaggaagguuaucaaguggacauuuaaaauguagacuaaaaauggauaaauuaagacuaaaaggaguaucauacagcuuguguacagcagcauuuacauuuacaaaaauaccagcagaaacauuacacgguacaguuacaguagaaguacaauaugcaggaacagacggaccuugcaaaguauuagcacaaauggccguagauaugcaaacacuaacaccaguaggaagauuaauaacagcaaauccaguaauaacagaaagcacagaaaacaguaaaaugauguuagaacucgauccacccuucggagauuccuacauagucauaggugugggagaaaaaaaaauuacacaucauuggcauagaagcggaagcacaauaggcaaagcauuugaagcaacagucagaggagcaaagcgaauggcaguucuaggagacacagccugggauuuuggaagu

SEQ ID NO: 2719 - RNA, 1353 nt, Artificial Sequence
  KY014314.1 solE CDS opt
agccaaaaaguaauauauuuaguaaugauauuacuaauagcaccagcauauaguauacgcuguauuggaguaucgaaucgagacuuuguagaaggaaugagcggaggaacauggguagauguaguacuagaacacggaggauguguuaccguuauggcacaggauaaaccaacaguagauauagaauuaguaacaacaacaguuaguaauauggcagaaguaagaagcuauuguuacgaagcaucaauaagcgacauggcaagcgauaguagaugcccaacacaaggagaagcauauuuagauaaacaaagugauacucaauauguaugcaaacgaacauuaguagacagaggauggggaaauggauguggauuauuuggaaaaggaagucuaguuacaugcgcaaaauuugcuuguagcaagaaaaugacaggaaaaucaauacaaccagaaaacuuggaauauagaauaauguuaucuguacauggaucacaacauucaggaaugauaguaaacgauacuggacacgaaacagaugaaaauagagcaaaaguugaaauuacacccaauagcccaagagcagaagcaacauuagggggauucggaucauuaggauuagacugugaaccaagaacaggauuagacuucucagauuuguauuauuuaacaaugaauaauaaacacuggcuaguacacaaagaaugguuucaugauauaccucucccauggcacgcaggagcugauacaggaacaccacacuggaauaacaaagaagcauuaguagaauuuaaagaagcacaugcaaaaagacaaacuguuguaguacuaggaagucaagaaggagcaguacacacugcauuagcaggagcuuuagaagcggaaauggauggagcaaaaggaagauuaucaaguggacaucuaaaauguagacuaaaaauggauaaacuaagauuaaaaggcguaaguuauagucuauguacggcugcguucacauucacaaaaauaccagcagaaacauuacacggaacaguaacaguagaaguacaauaugcaggcacagauggacccugcaaaguaccagcacaaauggcaguagauaugcaaacauuaacaccaguaggaagacuaauaacagcaaauccuguaauaacagaaaguaccgaaaauaguaaaaugauguuagaacuagauccaccauuuggagauaguuauauaguaaucggaguuggagaaaagaaaauaacucaucacuggcacagaagcgguaguaccauagguaaagcauuugaagcuacagugcgaggagcaaaaagaauggcaguuuuaggagauacagcaugggauuuuggaagu

SEQ ID NO: 2720 - RNA, 1353 nt, Artificial Sequence
  KX447517.1 solE CDS opt
ucacaaaaaguaauauacuuaguuaugauauuacucaucgcuccggcauauaguauaagauguauuggaguaucaaauagagauuuuguagaaggaaugucaggaggaacauggguagaugugguauuagaacauggcggaugcguaacaguaauggcacaagauaaaccaacaguagacauagaauuagucaccacaacagucagcaauauggcagaaguaagaagcuauugcuaugaagcaucaauaagugauauggcaagugauagcagauguccaacacaaggagaagcuuaucuagauaaacaaagugauacacaauacguauguaaaagaacauuaguugacagaggauggggaaacggcuguggacuauuuggaaaaggaaguuuaguaacaugcgcaaaauucgcauguagcaaaaaaaugacaggaaaaaguauucaaccagaaaaccuagaauauagaauaauguuaagcguacauggaagucaacauucaggaaugauaguuaacgauacaggacaugaaacagaugaaaauagagcaaaaguagaaauaaccccaaauaguccuagagcagaagcagcauuaggaggauuuggaucacuaggauuagauugcgagccaagaacaggguuagauuuuucagauuuauauuaucuaacaaugaauaacaaacauugguuaguacacaaagaaugguuccacgauauaccauuaccauggcacgcaggcgcggacacaggaacaccccauuggaacaauaaagaagcauuaguagaauuuaaagaugcgcaugcaaaacgacaaacuguaguaguacuuggaagucaagaaggagcugugcauacagcucuggcaggagcuuuagaagcagaaauggauggagcaaaaggaagauuaucaaguggucacuuaaaauguagauuaaaaauggauaaacuaagguuaaaaggugugagcuacaguuuaugcacagcugcauuuacauuuaccaaaauaccugcagaaacacuacacggcacaguuacuguagaaguccaauaugcaggaacagacggaccauguaaagugccagcacaaauggcaguagacaugcaaacauuaacaccaguggggagacuaauaacagcaaauccaguaauaacagaaaguacagaaaauaguaaaaugauguuagaauuagauccaccauucggagauucauauauagucauaggugugggugaaaaaaaaauuacacaucauuggcauagaucaggaucaacgaucgguaaagcauuugaagcaacaguacguggggcgaaacgaauggcaguauuaggagauacggcaugggacuuuggauca

SEQ ID NO: 2721 - RNA, 1353 nt, Artificial Sequence
  KU729217.2 solE CDS opt
ucacaaaaaguaauauaucuaguaaugauauuauuaauagcaccggcauauagcauaagauguaucggaguaaguaauagagacuuuguagaaggaaugaguggaggaacauggguugauguaguacuagaacauggaggaugcgugacaguaauggcucaagauaaaccaacaguagauauagaacuaguaagcacaacaguaaguaauauggcagaaguuagaagcuauuguuacgaagcaacaauaagugauauugcaagugacaguagauguccaacacaaggagaagcauaucuagauaaacaaagugauacacaauauguauguaaaagaacgcuuguagauagaggauggggaaauggcuguggacuauuuggaaaaggaagccuaguaacaugugcaaaauucgcaugcaguaaaaaaaugacaggaaaaaguauacagccagaaaauuuagaauacagaauaaugcuaaguguacauggaucacaacacaguggaaugauaguaaacgauacaggacaugaaacagaugaaaacagagcaaaaguagaaauaacaccgaauagcccgagggcugaagcaacauuaggaggauuuggaagcuuaggauuagauugugaaccaagaacaggauuagauuuuagugacuuauacuauuuaacaaugaauaauaaacacugguuaguacauaaagaaugguuccaugacauaccccuaccuuggcaugcaggugcagauacaggaacaccacauuggaauaauaaagaagcauuaguagaauuuaaagaugcucaugcuaaaagacaaacagcaguuguacuaggaucacaagaaggagcaguacauacagcacucgcaggggcauuagaagcagaaauggacggagcaaaaggcagauuaucaagcgggcauuuaaaauguagacuaaaaauggauaaauuaagacuaaaaggugugucauauucacuauguacagcugcauucacauuuacaaaaauaccagcagaaacauuacacggaacggucacagucgaaguccaauacgcaggaacagauggaccauguaaaguacccgcacagauggcaguagauaugcaaacacuuacaccaguagguagauuaauaacagcaaauccaguaauaacagaaaguacagaaaacaguaaaaugaugcuagaauuagauccaccauuuggagauucauauauaguaauuggagugggcgaaaaaaaaauuacacaucacuggcaucgaaguggaucaacaauaggaaaagcauuugaagcaaccguaaggggagcuaaaaggauggcagucuuaggagacacagcuugggauuucgguuca

SEQ ID NO: 2722 - RNA, 1353 nt, Artificial Sequence
  KY328290.1 solE CDS opt
agucaaaaaguaauauaucuagugaugauauuauuaauagcaccagcauauagcauaagauguauaggagugucaaacagagauuucguagaaggaaugucaggaggaacauggguagaugugguacuagaacauggagguugcguuaccguaauggcacaagauaaaccaacaguagacauagaauuaguaacaaccaccguaaguaauauggcagaaguuagaaguuauuguuaugaagcaagcauaagcgacauggcaagcgacagcagauguccaacacaaggagaagcauauuuagauaaacaaagcgacacacaauauguaugcaaaagaacuuuaguagauagggguuggggaaauggcuguggacuauuuggaaaagguaguuuaguaacaugugcaaaauuugcauguucaaagaaaaugacuggaaaaucaauacaaccagaaaauuuagaauaucguauaaugcuaaguguacauggaucacaacacaguggaaugauaguaaaugauacaggacaugaaacagaugaaaauagagcaaaaguagaaauaacaccaaacucacccagagcugaagcaacguuaggaggauuuggaucauuaggauuagauugugaaccaaggacaggauuagauuuuagugaucuauauuaucuaacaaugaauaauaaacacugguuaguucauaaagaaugguuucaugauauaccauuaccauggcaugcaggagcagacacaggaacaccacauuggaacaauaaagaagcgcuaguggaauuuaaagaugcacacgcaaaaagacaaacuguaguuguacuaggaagucaagaaggggcaguacauacggcucuagcuggagcacuggaagcagaaauggacggggcuaaagguagauuaucgagcggacauuuaaaauguagguugaaaauggacaaacuuagauuaaaagguguaucauauaguuuauguacagcagcguuuacguuuaguaaaauaccugcagaaacauuacacggaacaguaacagaagaaguacaauacgcaggaacggauggucccugcaaaguuccagcacaaauggcuguggacaugcaaacauuaacaccuguaggaagauuaauaacagcaaacccaguaauaacagaaagcacagaaaauaguaaaaugauguuagaauuagauccaccauuuggagauaguuauaucguaauaggaguaggagaaaagaaaaucacucaucacuggcauagaagcgguaguacaauaggaaaagcauuugaagcaacaguaagaggagcaaaaagaauggcaguacuaggagauacagcgugggauuuuggauca

SEQ ID NO: 2723 - RNA, 1353 nt, Artificial Sequence
  KX087101.3 solE CDS opt
ucacaaaaaguaauuuauuuaguuaugauauuacuaauagcaccagcauauucaauaagauguauaggagugaguaaucgagauuuuguagaaggcaugaguggaggaacuuggguagauguaguuuuagaacacggcggaugcguaacaguaauggcacaagauaaaccgacgguagacauagaauuaguaacaacaacaguuaguaacauggcagaaguaagaucauauuguuaugaagcaaguauaagugauauggcuagugauucaagauguccaacacaaggcgaagcauacuuagauaaacaaagcgauacacaauauguauguaagagaacauuaguagauagagguuggggaaauggauguggauuauuuggaaaaggaucacuaguaaccugcgcaaaauuugcuuguucaaaaaaaaugacaggaaaaucaauccaaccagaaaaucuagaauauagaauaauguuaucaguacaugggagccaacacucgggaaugauaguaaaugauacuggccacgaaacagacgaaaaucgagcaaaaguagaaauaacaccaaauucaccaagagcagaagcaacacuaggaggauuuggaucauuaggauuagacugugaaccaagaacuggacuagauuuuucagaccuauacuaucuaacaaugaauaauaaacacugguuaguacauaaagaaugguuucaugacauaccacugccauggcaugcaggcgcagauacgggaacgccacauuggaacaauaaagaagcauuaguugaauuuaaagaugcacaugcgaaaagacaaacuguaguaguauuaggaagccaagaaggagcaguucacaccgcauuagcuggagcguuagaagcagaaauggacggagcaaaagggagauuaucaagcggucaucuaaaaugcagacuaaaaauggauaaauuaagauuaaaaggaguaagcuauucgcuauguacagcagcauuuacauuuacaaaaauaccagcagaaacauuacauggaacaguaacaguagaauuacaauaugcuggcacagauggaccauguaaaguaccagcacaaauggcaguagauaugcaaacucuuacaccaguaggacgauuaauuacagcaaauccaguaauaacugaaucuacugaaaacaguaaaaugauguuagaauuagauccaccauuuggagauaguuauauaguaauaggaguaggagaaaaaaaaauaacacaucauuggcauagaucagguaguacaauaggaaaagcauuugaagcaacaguaagaggagcaaaaagaauggcaguuuuaggugauacagccugggauuuugguucg

SEQ ID NO: 2724 - RNA, 1353 nt, Artificial Sequence
  KY003156.1 solE CDS opt
agucaaaaagugaucuauuuaguaaugauucuacuaauagcaccagcauauucaauaagauguauaggcauaucuaacagggauuuuguugaaggaaugaguggaggaacuuggguagacguaguauuggaacauggaggauguguaacaguaauggcacaagauaaaccuacaguagacauagaacugguaacaacaacaguaaguaauauggcugaaguaaggucauacuguuacgaagcaaguauaagcgauauggcaagugauucaagaugcccaacacaaggagaagcauaucucgauaaacaaagcgauacacaauauguauguaaaagaacauuaguagauagaggauggggaaacgguugcggauuauuugggaaaggaucuuuaguaacaugugcaaaauucgcauguaguaaaaaaaugacaggaaaauccauacaaccagaaaacuuagaauauagaauaauguuaaguguacacgguagucaacauucaggaaugauuguaaaugauacaggacacgaaaccgacgaaaauagagcaaaaguagaaauaacaccaaacucaccaagagcagaagcaacacuaggaggauuuggaauacuuggauuagauugugaaccacgaacuggacuagauuuuucagaccuauauuaucuaacgaugaauaauaaacauuggcuaguacauaaagaaugguuucaugauauacccuuaccauggcaugcaggcgcagauacgggaacgccacauuggaacaacaaagaagcauuaguagaauuuaaagaugcacaugcaaaacgacaaacaguaguaguauuagggucacaagaaggagcaguacauacugcacuugcaggagcuuuagaagcagaaauggacggugcaaaaggaagauuaucaucaggacacuuaaaauguagauuaaaaauggacaaauuacgauuaaaaggaguaucauauagcuuaugcaccgcagcauuuacauuuacuaaaauaccugcugaaacauuacauggaaccguaacaguagaaguacaauaugcaggaacagauggaccauguaaaguaccagcacaaauggcaguagauaugcaaacacuaacaccaguaggaagacuuaucacagcaaauccaguaauaacagaaagcacggagaauucaaaaaugauguuagaacuagauccaccauuuggagacucauacauaguaauaggaguaggagaaaaaaaaauaacacaucauuggcacagaucaggaaguacuauaggaaaagcauuugaagcaacgguaagaggagcaaagagaauggcaguauuaggagauacagcaugggauuucggauca

SEQ ID NO: 2725 - RNA, 1353 nt, Artificial Sequence
  KU758876.1 solE CDS opt
ucacaaaaaguaauauauuuaguaaugauauuauuaauagcaccagcauauaguauaagauguauaggaguaaguaauagagauuucguagaaggaaugagugggggaacauggguagauguaguauuagaacauggaggguguguaacaguaauggcacaagacaaaccaaccguggauauugaauuaguaacuacuacagucaguaauauggcagaagucagaucauauuguuacgaagcuaguauaucagacauggcgagugauagcagauguccaacacaaggagaagcauauuuagauaaacaaagugauacucaauauguauguaaaagaacauuaguugauagaggguggggaaauggauguggauuauuuggaaaaggaagcuuaguaacaugugcaaaauucgcauguaguaaaaaaaugacaggaaaaaguauacaaccagaaaacuuagaauauagaauaaugcugaguguacauggaucacaacauucaggaaugauaguaaaugauacaggacaugagacagaugaaaacagagcaaagguagaaauaacuccaaacaguccacgagcagaagcaacacuagguggauuuggaucacuaggacuagauugugaaccuagaacaggauuagauuuuucagauuuauauuaucuuacaaugaacaacaaacauuggcuaguacauaaagaaugguuccacgauauaccacuaccauggcaugcuggagccgauaccggcacuccacauuggaacaauaaagaagcauuaguagaauucaaagaugcacacgcuaaaagacagacagugguaguauuaggaagucaagaaggagcaguacacacagcacuagcaggagccuuagaagcagaaauggaugggguaaaagguagguuaagcaguggacacuuaaaauguagauuaaaaauggauaaacuaagacuuaaagguguaaguuacucauuauguacagcagcuuuuacguuuacuaaaaucccugcagaaacacuacauggaacaguaaccguggaaguacaauacgcaggaacagauggaccauguaaaguaccagcacaaauggcuguagauaugcaaacauuaaccccaguaggaagauugauaacagcaaauccaguaauaacagaaaguacagaaaauaguaaaaugauguuagaauuagauccucccuuuggugauagcuauauaguuauagguguaggagaaaaaaaaauaacacaucauuggcacagaucaggcagcacaauagguaaagcuuuugaagcaacaguaagaggagcaaaacgaauggcaguguugggagauacagccugggauuuuggauca

SEQ ID NO: 2726 - RNA, 1353 nt, Artificial Sequence
  KU926310.1 solE CDS opt
agccaaaaaguaauuuauuuaguaaugauacuauuaauagcaccagcauauaguauaagauguauagggguauccaacagagauuucguugaaggaaugagcggaggaacauggguagauguaguuuuagaacaugguggauguguaacaguaauggcacaagauaaaccuacaguagauauagaauuaguaacaacaacaguaucaaacauggcagaaguaagaaguuauugcuaugaagcaagcauuagugauauggcaagugauagucgauguccaacacaaggagaagcauaucuagacaaacaaagugacacacaauacguauguaaaagaacauuaguagauagaggaugggguaauggcugcggacuauucgggaaaggauccuuaguaacuugugcaaaauuugccuguaguaaaaaaaugacaggaaaaucaauacaacccgaaaaucuagaauaccgaauaaugcuaaguguacacggaagucaacauucaggaaugaucgugaaugacacagggcaugaaacugaugaaaacagagcaaaaguagaaauuacaccaaauucaccaagggcugaagcaacauuaggaggauucggaaguuuaggacuggauugugaacccagaacuggauuagacuuuucagauuuauacuauuuaacaaugaauaacaaacacuggcuaguacauaaagaaugguuucacgauauaccauuaccauggcaugcaggagcagauacaggaacaccacauuggaauaauaaagaagcacuaguagaauuuaaagaugcacacgcuaaaagacaaaccguuguaguauuaggaucacaagaaggagcgguucacacagcacuagccggagcauuagaagcggaaauggauggagcaaaaggaagauuaucaucaggucacuuaaaauguagguuaaaaauggauaaacuaagacuaaaaggaguaagcuauagucuuuguacagcagcauucacauucacaaaaauaccagcagaaacauuacauggaacaguaacaguugaaguacaauaugcaggagcagacggaccaugcaaaguaccugcacaaauggcaguggauaugcaaacauuaacuccaguagguagguuaauaacagcaaacccaguaauaacagaaaguacggaaaauucaaaaaugaugcuagaauuagauccaccauuuggagauaguuauauaguaauaggaguaggagaaaaaaaaauuacacaccauuggcauagaucagguaguacaauaggaaaagcauuugaagcaaccguacguggagcuaaaagaauggcuguauuaggagauacagcaugggacuuugguagu

SEQ ID NO: 2727 - RNA, 1353 nt, Artificial Sequence
  KU681081.3 solE CDS opt
ucacaaaaaguaauauaucuaguuaugauacuauuaauagcaccagccuacaguauacgauguauuggaguaaguaauagagauuuuguugaaggaaugagugggggaacauggguagaugugguacuugaacauggaggaugugucacaguaauggcacaagauaaaccaacaguggauauagaauuaguaacaacuacaguaaguaacauggcagaaguaagaaguuauugcuacgaagcuucaauaagugacauggcaagugauagcagauguccgacacaaggcgaagcauaucuagauaaacaaagcgauacucaauauguauguaaaagaacauuaguagacagagguuggggcaauggauguggauuauuugguaaaggcucucuaguaacaugugcaaaauuugcauguucaaaaaaaaugacaggaaaaucaauucaaccagaaaaucuagaauauagaauaauguuaucaguccauggaagucaacauucagguaugauaguaaacgacacaggacaugaaacagaugaaaacagagcaaaaguagaaaucacaccaaauaguccaagagccgaagcaacuuuaggaggauucggaucauuaggauuagauugcgaaccaagaaccggguuagauuuuagugauuuauauuaucuuacuaugaauaauaaacauuggcuaguacauaaagaaugguuucaugauauaccauuaccuuggcacacuggagcagauacaggaacaccacauuggaacaauaaagaagcuuuaguagaauuuaaagaugcacaugcaaaaagacaaacaguaguaguauuaggaagucaagaaggagcuguacauacugcauuagcuggugcauuagaagcagaaauggauggagcaaaaggaaggcuaagcaguggacaucuaaaauguagauuaaaaauggauaaacuaagauuaaaaggaguaucauauagucuauguacagcagcauucacauuuacaaagauaccagcagaaacacuacacgguacaguaacgguagaaguccaauaugcaggaacagauggcccuuguaaagugccagcacaaauggcaguagauaugcaaacacuaacuccaguaggaagacuuauaacagcaaauccaguuauaacagaaggcacagaaaacaguaaaaugauguuagaacucgauccaccauuuggcgauucauauauaguaauaggaguaggagaaaaaaaaauaacacaucauuggcauaggucuggaucaacuauaggaaaagcauuugaggcaacuguaagaggagcaaaaagaauggcaguuuuaggugauacagcaugggauuuuggauca

SEQ ID NO: 2728 - RNA, 1353 nt, Artificial Sequence
  KU744693.1 solE CDS opt
ucacaaaaaguaauauauuuaguaaugauauuguuaauagcaccagcguacaguauuagauguauaggaguuagcaauagagauuuuguagaaggaaugaguggaggaaccuggguagauguaguauuagaacaugggggauguguaacagcaauggcgcaagauaaaccaacaguagacauagaauuaguaacaacuaccguuaguaauauggcagaaguacgaagcuauuguuacgaagcuucaauaagugauauggcaagugacagcagauguccaacacaaggagaagcguaccuagauaaacaaagugauacacaauacguaugcaaaaggacuuuaguagauagaggauggggaaauggaugugguuuauuugggaaaggaagccuuguaacaugugcaaaauuugcauguagcaaaaaaaugacagguaaaucaauacaaccugaaaaucuagaauauagaauaauguuaagcguacauggaucacaacauagcggaauguuaguaaacgauacaggacaugaaacagaugaaaauagagcaaaaguagaaauaacgccaaacucaccucgagccgaagcaacauuagguggauuuggaucauuaggauuagauugcgaaccaagaacaggcuuagacuuuagcgauuuauauuacuuaacgaugaacaauaaacauugguuagcucauaaagaaugguuucaugauauaccacuaccauggcacgcgggagcagcaacaggaacgccucauuggaauaauaaagaagcauuaguagaauuuaaagaugcacaugcuaaaagacaaacaguaguaguacuaggaagccaagaaggagcaguacacacagcauuggcaggagcauuggaagcagaaauggauggagcaaaaggacgauuaaguucuggacauuuaaaaugucgauuaaaaauggauaaacuaagacucaaagggguaucauacucauuauguacagcagcguuuacauucacaaaaauaccagcagaaacaguagaugguacaguaacaguagaaggacaauaugguggaacagacggaccaugcaaagugccagcacaaauggcaguagauaugcaaacacuuacaccaguaggaagauuaauaacagcaaauccagugauaacagaaucgacagaaaacaguaaaaugauguuagaacuagauccaccuuuuggagauucauauauuguaauaggaguaggggaaaaaaaaauaacacaucauuggcauagaucuggaagcacgauaggaaaagcuuuugaagcaacaguaagaggagcaaaaagaauggcaguuuuaggggauacagcaugggauuucggaagc

SEQ ID NO: 2729 - RNA, 1353 nt, Artificial Sequence
  EU545988.1 solE CDS opt
agccaaaaaguuauauaccuaguaaugauauuauuaauagcaccagccuauaguauacgaugcauuggaguaucaaauagagauuucguagaaggcaugucagguggaacauggguagauguaguauuagaacauggaggauguguaacaguaauggcacaagacaaaccagcaguagauauagagcuaguaacaacuacaguaucaaauauggcagaaguaagaaguuacuguuaugaagcuagcauaagcgauauggcaucugauucuagguguccaacacaaggcgaagcauauuuagauaaacaaucugauacacaauacgucuguaaaagaacucuaguagauagaggauggggaaacggaugugguuuauucggaaaaggcagcuuaguuacaugugcaaaauuugcaugcucaaagaaaaugacaggaaaaucaauacaaccugaaaaccuagaauacagaauaauguuaucagugcacggaucacaacauagcggaaugauagucaaugauacaggacaugaaacagaugaaaacagagcuaaagucgaaauaacaccaaacaguccaagagcugaagcaacauuaggaggauucgguagcuuaggacuugauugcgaaccaagaacaggacuagauuuuucagaucuuuauuacuuaaccaugaacaacaaacauugguugguacacaaagaaugguuucaugauauaccacuaccuuggcaugcaggagcagauacuggaacaccacauuggaacaauaaagaagcauuaguagaauuuaaagacgcucaugcaaaaagacaaacagucguuguauuaggaucacaagaaggagcaguacauaccgcucuagcuggagcauuagaagcagaaauggauggagcaaaaggaagauuaucaucaggacacuuaaaaugcagacuaaaaauggacaaauuaagacucaaaggaguaucuuauucauuaugcaccgcagcauuuacauuuacaaaaauaccagcagaaacacuacauggaacuguaacagucgaaguccaauaugcaggaacagauggaccgugcaaagucccggcacaaauggcaguagacaugcaaacuuuaacaccaguaggacgauuaauaacugcaaauccuguaauaacagaaagcacagaaaauucaaaaaugaugcuagaauuagauccacccuucggagauucauauaucguaauaggaguaggagaaaagaaaauaacacaucauuggcauagaucaggaagcacuauagguaaagcauuugaagcaacaguaagaggugcaaaaagaauggccguuuuaggugauacagcaugggauuuuggcagu

SEQ ID NO: 2730 - RNA, 1353 nt, Artificial Sequence
  KY007221.1 solE CDS opt
agucaaaaaguaauauauuuagugaugauacuauuaauagcaccagcauauaguauaagauguauaggugugaauaauagagauuuuguugaaggaaugucagggggaacauggguagaugucgucuuagaacacggagguuguguaacagugauggcacaagauaaaccaacaguagauauagaauuaguaacaaccacaguaaguaauauggcagaaguaagaucauauuguuaugaggcaaguauaagugauauggcaagugauaguagauguccgacacagggagaagcauauuuagauaaacaaagcgauacucaauauguauguaaaagaacauuaguagauagaggauggggaaauggaugcggauuguuuggaaaaggaagucuagugacaugugcaaaauuugcaugcuccaaaaaaaugacaggaaaaucaauacaaccagagaacuuagaauauagaauaauguuaaguguacauggaagucaacacagcggaaugauaguuaaugauacaggacaugaaacagaugaaaaucgagcgaaaguugaaauaacuccaaacucaccuagagcagaagcaacauuaggaggguucggaucauuaggacuagauugugaaccaagaacaggacuagauuucagugacuuauauuaucuaacaaugaauaauaaacauuggcuaguacauaaagaaugguuucaugauauacccuuaccauggcaugcgggugcagauacagguacaccacauuggaauaauaaagaagcccuuguggaauuuaaagaugcacacgcaaaaagacaaacaguagucguacuagguucacaagaaggagccgugcacacagccuuagcaggagcacuggaagcagaaauggauggggcaaaaggaagauuaucgaguggacaucuaaaaugcagacuaaaaauggauaaauuaagauuaaaaggaguaaguuauucauuauguacagcagcauuuacauuuacaaaaauaccagcagaaacauuacauggaacaguaacaguugaaguacaauaugcgggaacagacggaccauguaaaguaccagcacaaauggcaguagacaugcaaaccuuaaccccagucggaagacuaauaacagcaaacccgguaauaaccgaaaguacagaaaacucuaaaaugauguuagaacuagauccaccauuuggagauaguuacauaguaauaggagugggagaaaagaaaauaacacaucacuggcauagaagcggaagcacaauuggcaaagcauucgaagcaaccguaagaggagcaaaaagaauggcaguauuaggagauacugcaugggauuuuggauca

SEQ ID NO: 2731 - RNA, 1353 nt, Artificial Sequence
  KY003152.1 solE CDS opt
ucacaaaaaguaauauauuuagucaugauauugcuaauagcaccugcauauaguauaagauguauaggaguaaguaauagagacuuuguagaaggaaugagcggcggaacauggguagacguaguacuagaacauggaggauguguaacaguaauggcacaagauaaaccaacaguagauauagaauuaguaacaacaacaguaucuaacauggcugaaguaagaaguuauugcuacgaagcaaguauaagcgauauggcaucagauuccagauguccgacacaaggagaagcauauuuagauaaacaaagcgauacacaauaugugugcaaaagaacauuaguagauagaggauggggaaauggaugcggacuauuuggaaaagguagcuuaguaacaugugcaaaauuugcauguucuaaaaaaaugacaggaaaaagcauacaaccagaaaauuuagaauaucgaauaauguuaagcguacauggaucacagcauucaggaaugauaguaaacgauacaggucaugaaacagacgaaaauagagcaaaaguagaaauaacaccuaacuccccaagagcagaagcaacauuaggaggauuuggaucacuaggauuagauugugaaccaagaacuggacuugacuucagugacuuauauuauuuaacaaugaauaauaaacauugguuaguacauaaagaaugguuucacgacauaccauuaccauggcaugcaggagcagauacaggaacuccccauuggaauaauaaagaagcauuaguagaauuuaaagaugcacacgcaaaaagacaaacaguaguaguacuuggaagucaagaaggagcaguacauacagcuuuagcaggagcacuggaagcagaaauggacggugcuaaaggaagacuuucaaguggacaucuaaaaugucgguuaaaaauggauaaauuaagauuaaaaggcguaaguuauagcuuaugugcagcagcauuuacuuuuacaaaaauaccugcagaaacacuacacgguacaguuacgguagaaguccaauaugcuggaacggauggaccauguaaaguaccugcacaaauggcaguagauaugcagacauuaacuccagugggaagauuaaucacagcaaauccaguaauaacagaaaguacagaaaauaguaaaaugaugcuagaauuagauccaccauucggggauaguuauauaguaauaggaguaggugaaaaaaaaauaacacaucacuggcauagauccggaucgacaauaggaaaagcauuugaagcaacaguaagaggggcuaaaagaauggcaguauuaggagauacagcuugggauuuuggauca

SEQ ID NO: 2732 - RNA, 1353 nt, Artificial Sequence
  KX694533.2 solE CDS opt
ucacaaaaaguaauauaccuaguaaugauauuauuaauagcaccagcauauagcauaagauguauaggaguaaguaauagagacuuugucgaaggaaugaguggaggaacauggguagacguaguauuagaacauggaggauguguaacaguuauggcacaagauaaaccaacaguagacauagaacuaguaacaacuacaguuucaaauauggcugaaguaagaaguuauuguuacgaagcaaguauuagcgauauggcgagugauucaagaugcccaacucaaggagaagcauaucuagauaaacaaagugauacacaauauguauguaaaagaacacuaguagacagaggauggggaaauggauguggauuauuuggaaaaggaucauuaguuacaugugcaaaauuugcauguucaaaaaaaaugacaggaaaaaguauacaaccugaaaauuuggaauauagaauaaugcugaguguacauggaucacaacacaguggaaugauagucaaugauauuggacaugaaacagaugaaaaucgagcaaaaguagaaauaacaccgaauagcccaagagcagaagcaacuuuaggaggauuuggaucauuagggcuagauugugaaccuagaacuggacuagauuuuagugacuuguauuacuuaacaaugaauaacaaacacuggcugguacauaaagaaugguuucaugauauaccauuaccauggcacgcaggugcagacacaggaacaccacauuggaauaauaaagaagcauuaguagaauucaaagaugcacaugcaaaaagacaaacagugguaguauuaggaagucaagaaggagcaguacauacugcauuagcaggugcuuuagaagcagaaauggauggagcaaaaggaagauuaucuucaggacauuuaaaaugcagauuaaaaauggacaaauuaagguuaaaaggaguaaguuacagccuuuguacagcagcauuuacuuuuacgaaaauccccgcagaaacuuuacauggaacaguaacaguagaaguacaauaugcaggaacagacggaccaugcaaaguaccagcacaaauggcagucgauaugcaaacauuaacaccuguaggaagacucauaacagcgaauccgguuauuacugaaucaacagaaaauaguaaaaugaugcuagaauuagacccaccauuuggagauucguauauaguaauaggaguaggcgauaaaaaaauaacacaucauuggcauagaucaggaucaacaauaggaaaagcauuugaagcaacaguaagaggagcaaaaagaauggcaguauuaggagauacagcaugggacuuuggaucg

SEQ ID NO: 2733 - RNA, 1353 nt, Artificial Sequence
  KX601167.1 solE CDS opt
ucgcaaaaaguaauauauuuaguaaugauucuauuaauagcuccugcauauucaauaagauguauagguguaagcaauagagauuuuguagaaggaaugaguggaggaacguggguagauguaguauuagaacacggaggauguguaacuguaauggcacaagauaaaccaacuguagauauagaauuaguaacaacuacaguaucaaauauggccgaaguaagaagcuauugcuaugaagcuaguauaagugacauggcaucagacucaagauguccaacacaaggcgaagcauaccuagauaaacaaagugauacacaauaugucugcaaaaggacgcuaguagauagaggauggggaaauggauguggucuauuuggaaaagggucauuagucacaugugcaaaauuugcauguucaaagaaaaugacaggaaaaucaauacagccagaaaauuuagaauauagaauuauguuaaguguacacggaagccaacacucaggaaugauuguaaacgacacaggacaugaaaccgaugaaaacagagcaaaaguagaaauaacaccuaauucaccaagagcagaagcaacguuaggaggauuugguucuuuaggacuagauugugaaccaaggacaggacuagauuuuagugacuuauauuacuuaacaaugaacaauaaacauuggcuaguucauaaagaaugguuucaugauauaccucuaccauggcacgccggagcagauacuggaaccccacauuggaauaauaaagaagcauuaguagaauuuaaagaugcacacgcaaaaagacaaacuguaguaguauuagguucucaagaaggugcaguacacacagcuuuagcaggagcauuagaagcagaaauggauggugcaaaaggaagacuaaguaguggacacuuaaaauguagauuaaaaauggauaaacuaagauuaaaaggaguaucauauucauuauguacugcagcauucacauucacaaaaauuccagcagaaacuuuacauggaacaguuacaguugaaguacaauaugcaggaacagauggaccaugcaaaguaccagcgcaaauggcaguagauaugcaaacauuaacuccaguaggacgauuaauaaccgcaaauccaguaauaacagaaaguacagaaaacaguaaaaugaugcuugaauuagacccaccauuuggagauucauauauuguaauagguguaggagacaagaaaauaacacaccacugguacagaucgggaucaacgauaggaaaagcauuugaagcaacaguaagaggagcaaaaagaauggcaguauuaggagacacagcaugggauuuuggauca

SEQ ID NO: 2734 - RNA, 1353 nt, Artificial Sequence
  KY288905.1 solE CDS opt
ucacaaaaagugauauauuuaguaaugauauuacuaauagcaccagcauacaguauaagauguauaggaguaucuaauagagauuuuguagaaggaaugucaggaggaacauggguagauguaguacuagaacacggaggauguguaacaguaauggcacaagacaaaccaacaguagauauagaauuaguaacaacaacuguaagcaacauggcagaaguuagaaguuauuguuaugaagcaaguauaagugauauggcaagugauucaagauguccuacacaaggagaagcauacuuagacaaacaaagcgauacacaauauguuugcaaaagaacguuagucgaccgaggaugggggaacggauguggacuauuuggaaaaggaagucuaguaacaugugcuaaauuuacauguagcaaaaaaaugacaggaaaaucaauacaaccagaaaauuuagaauacagaauaauguuaagugugcauggaucacaacauagcggaaugauaguuaaugauacugggcacgaaacugaugaaaauagagcgaaaguagaagucacaccaaacaguccaagagcggaagcaacuuuaggaggauucgguucauuaggacuagauugcgaaccuaggacuggauuagauuuuucagaucuauauuaucuuacaaugaauaauaaacauugguuaguacauaaagaaugguuucaugauauaccacuaccguggcaugcaggagcagauacaggaacaccucauuggaauaacaaagaagcauuaguagaauucaaagaugcacaugcaaaacgacaaacgguaguaguacuuggaagucaagaaggagcaguacacacagcauuagcaggagcuuuagaagccgagauggacggggcaaaaggcagacuauuuagcggacacuuaaaaugcagauuaaaaauggauaaauuaagauuaaagggaguaaguuauucauuauguacagcugcauuuacuuuuacaaaaguuccagcagagacauuacauggaacaguaacaguggaaguacaauaugcaggaacagaugggccauguaaaguuccagcacaaauggcaguagauaugcaaacauuaacuccaguaggaagacuuauuacagcaaauccaguaauaacagaaaguacagaaaauaguaaaaugaugcuugaauuagacccaccauuuggggauucuuauauagucauaggaguuggagauaaaaaaauaacucaucauuggcauagaucuggcucaacuauaggaaaagcguuugaagcaacgguaagaggagcaaaaagaauggcuguacuaggcgacacagcuugggauuuuggauca

SEQ ID NO: 2735 - RNA, 1353 nt, Artificial Sequence
  KF268950.1 solE CDS opt
ucacaaaaaguuauauauuuaguaaugauauuguuaauagcaccggcauauaguauaagauguauaggaguaucaaauagagauuuugucgaaggaaugaguggaggaacauggguugauguaguauuagaacauggcggaugcguaacuguaauggcacaagauaaaccaacuguggauauagaauuaguaacaacaacaguaagcaauauggcagaaguaagaaguuauuguuaugaagcaucaauaagugauauggcaagugauucucgaugcccgacacaaggagaagcauacuuagauaaacaaagugauacacaauauguaugcaagcgaacacuuguagacagaggauggggaaacggaugugguuuauucgguaaaggaaguuuaguaacuugugcaaaauuuacauguagcaaaaaaaugacaggaaaaucaauacaaccugagaauuuagaauauagaauuaugcuaagcguacacgggucacaacauagcggaaugauaguaaaugauauaggacaugaaacagaugaaaauagagcaaaaguagaaguaacuccaaauaguccaagagcagaagcaacauuagggggcuucgguucauuagguuuagacugcgaaccacggacuggacuagacuucucagauuuauauuauuuaacaaugaauaacaaacacuggcugguacauaaagaaugguuucacgauauaccuuuaccauggcaugcgggcgcagauacaggaacaccucauuggaauaacaaagaagcacuaguagaauuuaaagaugcacaugcaaaacgacaaacaguaguaguauuaggaagucaagaaggggcaguacauacagcacuagcgggagcauuagaggcagaaauggauggagcaaaaggaagguuauucagcggacauuuaaaauguagacuuaaaauggauaaauuaagauuaaaaggaguaagcuauaguuuauguacagcagcauuuacauuuacaaaaguaccagcagaaacauuacauggcacaguaaccguagaaguacaauaugcaggaacagauggaccaugcaaaguaccagcucaaauggcuguagauaugcaaacacuaacaccuguaggaagacugauuacagcuaauccagucauaacagaaaguacggaaaauagcaaaaugauguuagaacuagauccaccauuuggggauagcuacauaguaauaggaguaggagauaaaaaaauaacacaucacuggcauagaucaggaucaacaauaggaaaagcauuugaagcaacaguaagaggagcaaaacgcauggcaguauuaggggacacagcuugggauuuuggauca

SEQ ID NO: 2736 - RNA, 1353 nt, Artificial Sequence
  KF383116.1 solE CDS opt
agucaaaaaguuauauauuuaguuaugauauuacuaauagcaccagcauauucaauaagauguauaggaguaagcaacagagauuuuguugaaggaaugagcgguggaacauggguagacguaguauuagaacauggaggauguguaacaguaauggcacaagauaaaccaacaguagacauagaacuaguaacaacaacaguuucaaauauggcagaaguaagaaguuauugcuaugaagcaaguauaagugacauggcaagugauaguagauguccaacucaaggugaagcauacuuagauaaacagagugacacacaauacguauguaaacgaacucuaguagacagaggcuggggaaauggaugugggcuuuucggaaaaggaucauuaguuacgugugcaaaauuuacaugcaguaaaaaaaugacaggaaaaucaauacaaccagaaaaucuggaauauagaauaauguuaagcguacauggaagucaacauucaggaaugauaguaaacgauaucggacaugaaacagaugaaaacagagcaaaaguagaaguaacuccaaauagcccaagagcagaagcaacauuaggaggauuuggaucauuaggucuagauugugaaccaagaacaggacuagauuuuagugaucuauacuaucuaacaaugaauaauaaacauugguuaguacacaaagaaugguuccaugauauaccauuacccuggcaugcaggagcagacacaggaacaccacauuggaacaauaaagaagcauuaguagaauuuaaagacgcacaugcaaaaagacaaacuguaguagugcuaggaagucaagaaggagcuguacacacagcacuagcaggugcauuagaggcagagauggauggagcaaaaggaagauuauuuaguggacaucuaaaguguagacuaaaaauggacaaauuaagauuaaaaggaguaaguuauagucugugcacagcuguaugcacagcagcaaaaguaccagcagaaacuuuacauggaacaguaacuguagaaguacaauaugcagggacagaugguccuuguaaaguaccagcucaaauggcaguagacaugcaaacgcuaacaccaguaggaagacuaaucacagcaaauccaguuauaaccgaaaguacagaaaauagcaaaaugauguuagaacucgauccuccauuuggagauagcuauaucguaauaggaguaggagacaaaaaaauaacucaucauuggcauagaaguggaucaacaauaggaaaagcauuugaagcaacaguaagaggugcaaaaagaauggcaguacuaggagacacagcaugggacuuuggauca

SEQ ID NO: 2737 - RNA, 1335 nt, Artificial Sequence
  KU963574.2 solE CDS opt
ucacaaaaaguaauauacuuaguuaugauauuacuaauagcaccggcuuauaguauaagaugcauaggaguaagcaauagagauuuuguagaaggaaugagcggaggaacauggguagauguaguauuagaacacggaggcugcguaacaguaauggcucaagauaaaccaacuguagauauagaacuaguaacaacuacaguaucaaauauggcagagguaagaaguuauuguuaugaagcaucaauaagcgauauggcaucagacaguagauguccaacacaaggugaagcauauuuagauaaacaaagugauacacaauauguauguaaaagaacccuaguagacaggggauggggaaauggcuguggauuauuuggaaaaggaucacuaguuacaugugcaaaauucacauguagcaaaaaaaugacaggaaaaucaauacaaccagaaaacuuagaauacagaauaauguuaaguguacacggaagccaacauucagguaugauaguaaaugaugaaaacagagcaaaaguagaaguuacaccaaauucaccaagagcagaagcaacacuaggaggauuugguucucuuggauuagauugugagccaagaacaggucuggauuuuagugacuuauauuacuuaacaaugaauaauaaacauugguuaguucacaaagaaugguuccaugauauucccuuaccauggcauucaggagcagauacagaaacaccacauuggaauaauaaagaagcauuaguagaauuuaaagaugcacaugcaaaaagacaaacaguuguuguacugggaagccaagaaggggcaguacauacagcauuagcuggagcacuagaagccgaaauggauggagcgaaaggcagacuaucaaguggacauuuaaaauguagauuaaaaauggauaaauuaagauuaaaaggaguaagcuacucauuauguacagcagcauucacauuuacaaaaguaccagcagaaacauuacaugguacaguaacaguagaaguccaauaugcuggaagagauggaccauguaaaguaccagcacaaauggcaguagauaugcaaacauuaacaccaguugguagauuaauaacagcuaauccagugauaacugaaucaacagaaaauaguaagaugauguuagaacuagauccaccauucggagacaguuauauaguaauaggagucggagauaaaaaaauaacgcaucauuggcauagaagcggaaguauuauaggaaaagcauucgaagcaacaguaagaggagcaaaaagaauggcgguacuaggagauacagcuugggauuuugguagu

SEQ ID NO: 2738 - RNA, 1353 nt, Artificial Sequence
  KF383118.1 solE CDS opt
ucgcaaaaaguaauauaucucguuaugauaguucuaauaguaccagcuuacaguauaagcuguauaggaguaucaaauagagacuuaguggaaggcaugagcggagguacauggguagacguaguauuagaacacggaggaugcguaacagaaauggcccaagauaaaccaacuguggauauagaauuaguaacgaugacaguaagcaauauggcugagguaagaagcuauuguuacgaagcaaguuuaucagauauggcuagcgcaucaagguguccaacacaaggcgaaccaucauuagauaaacaaagugauacucaaaguguauguaaaagaacucuaggagauaggggauggggaaauggaugcggaauauucgguaaaggaagucuaguaacaugcaguaaauucacauguuguaaaaaaaugccuggaaaaucaauucaaccagaaaauuuagaauacagaauaaugcuaccaguacauggaagucaacauagcggaaugauaguuaaugauauaggacaugaaacugaugaaaacagagcaaaaguagaaguaacuccaaacagcccuagagcagaagcaacacucggaggauucggaucacucggauuagauugugaaccaagaacaggacuugacuucagugaucuuuacuauuuaacgaugaauaacaaacauugguuaguacauaaagaaugguuccaugauauaccauuaccauggcaugcaggagcagauacaggaacaccacauuggaacaauaaagaagcguuaguagaauuuaaagaugcacaugcaaaaagacaaacaguaguaguauuaggaagccaagaaggagcuguacacacggcacuagcaggggcauuagaagcagaaauggauggagccaaagguagauuauuuaguggacauuuaaaauguagauuaaaaauggauaaacuaagacuaaaaggaguaaguuacagcuuauguacagcagcauuuacauucacaaagguaccagccgaaaccuuacacggaacaguuacaguagaaguccaaagugcaggcacagaugguccauguaaaguaccggcacaaauggcaguagauaugcaaacuuuaacaccuguaggaagguuaauaacagcaaauccaguaauaacagaaagcacagaaaauaguaaaaugaugcuagaauuagacccaccauuuggagauucauauauaguaauaggagucggagauaaaaaaauaacacaucauuggcacagaaguggaucaacaauaggaaaagcauuugaagcaacaguaagaggcgccaaaagaauggcaguauuaggagauacagcaugggauuuuggaucu

SEQ ID NO: 2739 - RNA, 1353 nt, Artificial Sequence
  KX520666.1 solE CDS opt
agacaaaaaguaauauauuuaguaaugauauuacuaauugcaccugcauauucaauaagaugcauagguguuaguaauagagauuuuguugaaggaaugucaggaggaacuuggguagacguaguacuagaacaugguggcuguguaacaguaauggcacaagauaaaccaacaguagauauagagcuaguuacgacaacaguuagcaacauggcagagguaagaaguuauuguuaugaagcaaguauaucagacauggcaagcgauucaagguguccaacacaaggugaagcauacuuagauaaacaaagugauacacaauacguauguaaaagaaccuuaguugauagagguuggggaaaugguuguggacuauuuggaaaaggaaguuuaguuacaugcgcaaaauuugcauguaguaaaaaaaugacaggaaaaucaauacaaccagagaauuuagaauauagaauaaugcuuaguguacauggaagucaacauagcggaaugauaguaaaugacacaggacaugaaacugaugaaaauagagcaaaaguagaaauaacaccaaauucacccagagcagaagcuacauuaggaggauuuggaucauuaggauuagacugugaaccuagaaccggauuagauuuuucagaucuauauuacuuaacaaugaauaauaaacauugguuaguacauaaagaaugguuucaugauauaccguuaccauggcaugcaggcgcagauacaggaaccccacacuggaauaauaaagaagcacuaguagaauuuaaagaugcccaugcaaaacgucaaacuguaguaguacuaggaucacaagaaggagcaguacacacugcauuagccggagcuuuagaagcagaaauggauggagcgaaaggaagacuaucaucuggacaccuaaaauguagauuaaaaauggauaaauuaagauuaaaaggaguaaguuauaguuuaugcacagcagcauucacauuuacgaaaauuccagcagaaacauuacacggaacaguaacaguagaaguucaauaugcgggaacagacggaccauguaaaguaccagcacaaauggcaguugauaugcagacauugacucccguuggaagacuaauaacagcaaauccaguaauaacugaaucaacagaaaacucaaaaaugaugcuagaauuagauccaccauuuggagauucauauauaguaauaggaguaggugaaaaaaaaauaacucaucauuggcacagaagugggaguacaauaggaaaagcauuugaagcaacuguaagaggggcaaaacgaauggcaguacuaggagauacugcaugggauuuuggaagc

SEQ ID NO: 2740 - RNA, 1353 nt, Artificial Sequence
  KF383120.1 solE CDS opt
agucaaagaguaauauacuuaguaaugauauuauugauagcaccagcauauucaauuagauguauaggaguaaguaauagagauuuuguagaaggaaugaguggaggaacauggguagauguaguauuagaacauggaggauguguaacuguuauggcacaagauaaaccaacaguagauauagaauuaguaacaacaacaguaucaaauauggcagaaguaagaagcuacuguuacgaagcaucaaucucugauauggcaagugauaguagauguccgacacaaggagaagcuuauuuagauaaacaaagcgauacacaauauguaugcaaaagaacauuaguugauagaggauggggaaauggauguggauuauuuggaaaagguagucuaguaacaugugcuaaauuuacauguagcaaaaaaaugacaggaaaaaguauacaaccagaaaaucuagaauauaggauaaugcuaucaguacacggaagucaacacagcggaaugauuguaaaugacauaggacacgaaacagaugaaaaucgagcaaaaguagaaguaacuccaaauucaccuagagcagaagcaaccuuaggagguuuugggucauuaggacuagacugugaaccaagaacaggauuagauuuuagugacuuauauuacuuaacaaugaauaauaaacauuggcuaguacacaaagaaugguuucacgauauaccacuaccauggcacgcaggagcagauacuggaacaccacauuggaauaauaaagaagcauugguugaauuuaaagaugcacaugcuaaaagacaaaccguaguaguguuaggcagccaagaaggagcaguacauacagcuuuagcaggagcauuagaagcagaaauggauggagcaaaagguagauuauuuucaggacaucugaaauguagaauaaaaauggauaaauuaagauuaaaaggaguauccuauaguuuauguacagcagcauucacguuuaguaaaguaccagcagaaacguuacaugguacaguaacaguagaaguacaauaugcagguagggacggaccguguaaaguaccagcacaaauggccguagauaugcaaacauuaacaccaguaggacgauuaauaacagcaaacccaauaauaacagaaucaacugaaaauaguagaaugauguuagaauuagauccaccauuuggagauucauauauaguuauagguguaggagauaaaaaaauaacccaucauuggcauagaaguggcucaacaauagguaaggcauuugaagcgacaguaagaggagcgaaaagaauggcugugcuaggagauacugcaugggauuuuggaagc

SEQ ID NO: 2741 - RNA, 2136 nt, Artificial Sequence
  ZIKV (strain ZikaSPH2015) Polyprotein(93-804) CDS opt
cguauaaucaacgcacgaaaagagaagaaaaggcgcggcgccgacacuucagucgguaucgucggccuccuccucacaaccgccauggccgcagaagucacccgccgaggaagugcauacuacauguaccuagaccgcaaugacgccggagaagcaaucagcuuccccaccacacucgguaugaacaaaugcuacauacaaauaauggaccucggucacaugugcgacgccacgaugagcuacgaaugccccaugcucgacgaaggggucgaaccagacgacguugacugcuggugcaacacaaccucuacuugggucgucuacgguaccugccaccacaagaaaggcgaagcgcgacgaucccgcagggccgucacccugccgagccauucaacccgaaaacuacaaacccgaagccaaaccuggcucgaaucucgcgaauacaccaaacacuugauccgcgucgaaaacuggauuuucagaaacccaggcuucgcacucgcggcagccgcaauagccuggcuccucggcucaucaacaucccagaaagucaucuaccucguaaugauucuacucaucgccccagcauacucaauacggugcauaggaguguccaaccgcgacuucgucgagggaaugucaggcggcacauggguagacauaguacucgaacacggaggaugcgucaccguaauggcccaagacaaaccaaccguugacauagaacucguaaccacaaccguaagcaacauggcagaaguccgcucauacugcuacgaggcauccaucagcgacauggccuccgacagccgaugccccacccaaggagaggccuaccucgauaaacaaagcgacacccaauacgucugcaaaagaacccucguagauagagguuggggcaacggcugcggucuauucggcaaaggaagccuaguaacaugcgccaaauucgccugcuccaagaaaaugaccggcaaauccauccaaccggagaaccuugaauauagaaucaugcuguccguacacggaucccaacacuccggaaugauagucaacgacacaggccacgagaccgacgagaaccgagcaaaaguagagaucacacccaacucgccaagagccgaagccacccuagguggcuucggaucacuuggccucgacugcgaaccccggacagggcucgacuucucagaccucuacuaccucaccaugaacaacaaacacuggcuuguacacaaagaaugguuucacgacaucccacucccauggcaugcaggcgcagacaccggcacaccacacuggaacaacaaagaagcccuagucgaguucaaagacgcacacgcaaaacgccaaacagugguaguccuggguucccaagaaggcgccguccacacagcccucgccggcgcccucgaagcagaaauggacggcgcaaaaggacgccuuagcuccggccaccuaaaaugcagacucaaaauggacaaacuccgccuuaaaggcguaucauacagccucugcacagcugcauucaccuucaccaaaauacccgccgaaacccuccacggaacagucaccgucgaaguacaauacgcaggaacggauggcccuugcaaaguaccagcccagauggccgucgacaugcagacccuaacaccagucggaagacucauaaccgccaauccagucauaacagaguccaccgaaaacuccaaaaugaugcucgaacuagacccuccauuuggcgacuccuacauagucauaggcguaggagaaaagaaaauaacacaccacuggcaccgcuccgguuccaccauuggaaaagcauucgaagcgacaguacgcggggcaaaacguauggcggugcucggcgacaccgccugggacuuuggguccgucggcggcgcccucaauucacucggcaaaggaauacaucaaaucuucggagcggccuucaaaucccuauucggcggcaugagcugguucucccaaauacugaucggcacacuacucauguggcuaggccucaacaccaaaaacggcucaaucucccucaugugccuggcacucggcggcguacucaucuuccuauccacagcagugagugccgacgugggaugcuccguagacuucucgaaa

SEQ ID NO: 2742 - RNA, 2136 nt, Artificial Sequence
  ZIKV (isolate Z1106033) Polyprotein(93-804) CDS opt
cgcaucaucaacgcccgaaaagaaaagaaacgacgaggagcggacacgucagucggcaucguaggauuacugcucaccacagcaauggccgccgaagucacccgcaggggcagcgcauauuacauguaccuugaccgaaacgacgcgggggaagcaauaucguuccccaccacgcuaggcaugaacaaaugcuacauccaaauaauggaccuaggccauaccugcgacgccacaaugucauacgaaugcccaaugcuagacgaaggcguagaacccgacgacguagacugcuggugcaacacaacaagcacaugggucgucuacgggacaugccaccacaagaaaggcgaagcucgcagaagcagacgcgccgucacacugccaagccacuccacccgaaaacuacaaacccgcagccaaaccuggcucgaaagccgcgaauacacaaaacaccucauacgagucgaaaacuggaucuuccgaaaccccggcuucgcccuggcagcagcagccauagccuggcuccuaggcucaagcacaagccaaaaaguaauauaccuagucaugauccuacuaaucgcgccagcguacucaauccgaugcaucggugucagcaaccgagacuucgucgaaggcaugucagguggcaccugggucgaugucguccuggaacacggcgguugcgucacggucauggcccaggauaaaccuaccguagacauagaacuggucaccacgaccguaagcaacauggcagaagugaggagcuauugcuacgaagcaucaauaucggacauggccucugauucgcgaugcccgacccaaggcgaggcauacuuggauaaacaaucagauacccaauacguauguaaacgaacgcuaguagaccgagggugggggaacgguugcggacucuuuggaaaaggcucccuaguaaccugcgccaaauucgcguguucaaagaaaaugacaggcaaaucaauacagccagaaaaccucgaauaccggauaaugcucuccguccacgggucccaacacagcggcaugauagucaacgacacaggccacgaaacagacgaaaauagggccaaagucgaaauaacaccaaacucaccacgagcggaagccacgcucggcggauucggaucccuaggccucgacugugaaccccggaccggccuggacuuuagcgaccuauacuaccucacaaugaacaacaaacacuggcucguccacaaagaaugguuucacgacaucccccugccauggcacgcgggcgcagacacuggcacaccacacuggaacaacaaagaagcucuugucgaguucaaagacgcacacgccaaaagacaaacagucgugguacucggaucccaagaaggagccguacacaccgcccucgccggcgcccucgaagccgagauggacggugccaaaggacgccucagcagcggacaccuaaaaugcagacuaaaaauggacaagcucagacucaagggcguauccuacucccucugcaccgccgccuucaccuucacaaaaauccccgccgaaacccuacacgggaccgucaccgucgaaguacaguacgccggcacagauggccccuguaaaguaccagcccaaauggccgucgacaugcaaacccugacacccgucggacgccuaauaacggccaaccccgucaucaccgaaucaaccgaaaacuccaaaaugaugcucgaacuagacccacccuucggcgacagcuacaucgucaucggggucggagaaaagaaaauaacccaccacuggcaccgauccgggucaaccaucggcaaagcauucgaagccaccguccgcggcgcaaaacgcauggcgguccugggagacacagcuugggacuucggauccgucggcggcgcccuaaacucacucggaaaaggcauucaccaaaucuucggcgccgccuuuaaaagccucuucggcggaaugucgugguucucccagauccuuauaggaacccuacuaauguggcucggcuugaacgccaaaaacggaagcauaagucugaugugccucgcacucggaggcguccuaaucuuccuaagcaccgcaguaagcgccgacguuggauguaguguagacuuuuccaaa

SEQ ID NO: 2743 - RNA, 2124 nt, Artificial Sequence
  ZIKV (strain MR 766) Polyprotein(93-800) CDS opt
agaauaaucaacgcccgaaaagaacgcaaacgcagaggagccgacacaagcauaggcauuaucggccuacuucucaccaccgcaauggcugcagaaaucaccagacgaggaagcgccuauuacauguaucucgacagaucagaugcaggaaaggcaaucuccuucgccaccacacucggaguaaacaaaugccacgugcaaaucauggaccucggacacaugugcgacgcgacaaugucauacgagugccccaugcuagacgagggagucgagccagacgacguagacugcuggugcaacacaaccucaaccugggucgucuacggaacaugccaccacaaaaagggggaagcacgccgaagccgcagagcggucacacuaccaagucacuccacacgcaagcuccaaacccggagccagaccuggcuagaaucccgggaauacaccaaacaccuaauaaaaguagagaacuggauauuucggaacccaggauucgcgcucgucgccguagccaucgcauggcuacuaggcuccagcacaucacaaaaagucauauaccuuguaaugauccuccucaucgcccccgcauacuccauccgcugcauaggagucagcaaucgcgacuucgucgaaggcaugucaggaggaaccuggguagauguaguacucgagcauggcggcugcgucacagucauggcacaagacaaaccaaccguagacaucgaacucgucacaaccaccgugagcaacauggcugaaguccggucauacugcuacgaggcaucaauauccgacauggccuccgacagccgcugcccaacccaaggcgaagccuaccucgacaaacagagcgacacacaauacgucugcaaacgaacccucguagacagaggcugggggaacggaugcggacuauucggcaaaggaucccucguaaccugcgccaaguucacgugcagcaagaaaaugaccggcaaauccauucaacccgaaaaccuagaguaccgcaucaugcuaucaguccacggcagucaacacucagggaugaucggcuacgaaaccgacgaagaccgcgccaaaguggaagucacaccaaacucaccacgcgccgaagcaacacuaggcggguucggaucccugggacucgacugcgagccccgcacgggccuagacuuuagcgaccuuuacuaucuaaccaugaacaacaaacacuggcuaguacacaaagagugguuccacgacaucccacuaccguggcacgcaggggcagauaccggcacaccgcacuggaacaauaaagaagcccuaguagaguucaaagacgcacacgccaaacgacaaaccguaguggucuuaggaucccaggaaggagccguacacaccgcccucgccggagcccuagaagccgaaauggacggcgccaaaggccgccuauuuucgggccaccucaaaugccgccugaaaauggacaaacuacgccuaaaagggguaaguuacucccucugcaccgccgcauucacauucacuaaagucccagccgaaacccuccacggcacaguaacaguagaaguccaauacgccggaaccgacggacccugcaaaauccccguacaaauggcaguagauaugcaaacccuaacccccgucggccgccuaauaacagccaaucccguaauuaccgaauccacagagaacagcaagaugaugcucgaacuugacccacccuucggcgacucguacauagucaucggagucggcgacaagaaaauuacacaccacuggcaccggucaggaucgacaaucggcaaagcguucgaggcaaccguacgaggagccaaaagaauggccguacuaggugacaccgcgugggacuucggcuccguagggggcguauucaacucccuaggaaaaggaauccaccagaucuucggcgccgcauucaagucacuauucggggguaugagcugguucagccaaauccuaaucggcacccuacugguguggcucggucucaacaccaaaaacggaucaaucucccucacaugccuagcauuagggggagucaugaucuuccucagcacagcagucucagccgacgugggaugcagcguagacuucucaaaa

SEQ ID NO: 2744 - RNA, 2136 nt, Artificial Sequence
  ZIKV (strain NatalRGN) Polyprotein(93-804) CDS opt
agaaucaucaacgccaggaaagaaaagaaaagacgaggagcagauaccaguguaggcauaguaggcuuacuccucacuacagcaauggcagccgaaguaacaagacggggcuccgcguacuacauguaccucgaccgaaacgacgcaggagaggcgaucagcuuccccacgacgcuagggaugaacaaaugcuacauacaaaucauggaccucggccacaugugcgacgcaacaaugagcuacgaaugccccaugcuggaugaaggaguggagcccgacgacguagacugcuggugcaauaccacaaguaccugggugguguacggaacaugccaccacaagaaaggcgaagcccgacgaucgcgccgagccguaacucugccgucccauucgaccagaaaacuccaaacaagaucacagacauggcuagagucacgggaauauacaaaacaccucauccgcguagaaaacuggauauuccgaaacccgggcuucgcccucgcagcggcagcaaucgccuggcugcuggggaguucgaccagccaaaaagucauauaccuaguaaugauccuacucaucgcaccggcuuacagcauacgcugcauaggagucucaaaccgagacuucgucgaaggaaugagcggcggcaccuggguagacguaguacucgagcacggcgggugcguaaccgucauggcacaagacaaaccaacaguagacauugagcuagucacgacaacaguauccaacauggcugaaguaagaaguuacuguuacgaagccagcaucagcgacauggcaagcgacucucgcugccccacccaaggagaagccuaccucgacaaacagucagacacccaguacguauguaaacgaacgcuaguagacagaggcuggggcaacggauguggccuuuuuggaaaaggauccuuagucacaugcgccaaauucgccugcagcaagaaaaugacagggaaaucaauccagccagaaaaccuagaauaccggaucaugcucagcguccacggcucccagcacucgggaaugaucguaaacgacacaggccacgaaacagacgaaaaucgcgccaaaguagaaauaaccccgaacagcccccgcgcagaagccacucuaggagguuucggaagccucggucuagacugcgagccccgcaccgggcuagacuucagugaccuauacuaccugacaaugaacaacaaacacuggcuaguccacaaagaaugguuccaugacaucccacuaccguggcacgcaggcgcagauaccggcaccccacacuggaauaacaaagaagcccucgucgaguucaaagacgcgcacgccaaacgccaaacuguggucguacucgggagucaggaaggcgcaguacacaccgcacucgcaggcgcccuagaagcagaaauggacggcgcaaaaggacgccuauccagcggacaccucaaguguagacuaaaaauggacaaacuccgacucaaagguguaagcuacucccuaugcacggcagcauucaccuucacgaaaauaccagcggaaacacuccacggaacaguaacaguagaaguccaauacgcagggacugacgggccaugcaaaguacccgcgcaaauggcaguagacaugcaaacacucacaccggucggacgacuaauaacagcaaacccgguaaucaccgaaagcaccgaaaacagcaaaaugaugcucgaacuagacccacccuucggagacucauacaucgucaucggcguaggagaaaagaaaaucacgcaccacuggcacagaucaggaucgacuauaggcaaagccuucgaagcaacagucagaggggccaaacgcauggcaguacugggggacacagccugggacuucggguccgucggcggggcucuaaacagccuaggcaaagggauacaccaaaucuucggcgcagcauucaaaucacucuucggcggcaugagcugguucagccaaauccuaaucggaacacuacucauguggcuaggguuaaacaccaaaaacggcagcaucagccucaugugcuuagcccuaggcgggguacucauauuucuaagcacagcaguaagcgccgacguaggaugcagcguagacuucucaaaa

SEQ ID NO: 2745 - RNA, 2061 nt, Artificial Sequence
  ZIKV (strain ZikaSPH2015) Polyprotein(108-794) CDS opt
acguccguaggcaucguggggcuccugcuaacgacggccauggcagcagagguaacccgccgaggcucagcauacuacauguaccuagaccgaaacgacgcgggagaagccaucagcuuccccaccacccucggaaugaacaaaugcuacauccaaauaauggaccucggccacaugugcgacgcgacaaugucauacgaaugcccaauguuagacgaaggggucgaacccgacgacgucgacugcuggugcaacaccacaagcacauggguaguauacgguaccugccaccacaagaaaggcgaagccagacgcagccgcagagccguaacccucccgucccacagcacacggaaacuccagacacggagucaaacauggcuggaaucgcgcgaauacaccaaacaccuuauaagaguagaaaacuggaucuuccgaaacccgggcuucgcgcucgccgcagccgccaucgcauggcuccugggguccagcaccagccaaaaagucauauaccucgucaugauccuccucauagcccccgccuacuccauccgcugcaucgguguguccaaccgagacuucguagaaggaaugucgggaggaacauggguagacauaguccucgaacacggcgggugcgucaccgucauggcgcaagacaaaccaacaguagacauagagcuaguaacaacaacagucagcaacauggcugaaguccgauccuacugcuacgaagcaucaaucagcgacauggcaucugacagucgaugccccacacaaggugaagccuaccucgacaaacagucagacacacaauacguaugcaaacgcacacucguagacagaggcuggggcaacggaugcggacuguucggcaaaggcucacugguaacaugcgccaaauucgcaugcagcaagaaaaugacaggcaaaagcauccaaccagaaaaccuagaauaccgcaucaugcuaagcguccacggaagccaacacagcggcaugauagucaacgacaccgggcacgaaacagacgaaaaccgagccaaagucgaaaucacgccaaacagcccccgcgccgaagcaacacuaggcggcuucggaagccucggccuagacugcgaaccacgcacaggacuagacuucagcgaccuauacuaccucacuaugaacaacaaacacuggcuaguacacaaagaaugguuccacgacauaccccucccuuggcacgccggcgccgacaccgguacaccccacuggaacaacaaagaagcccucguagaguucaaggacgcucacgccaaacgacaaaccgucgucguucucggaucccaagaaggcgcaguacacacagcacuagccggcgcccuagaagcugaaauggacggagccaaaggacgccuaucaucaggacauuuaaagugccgccucaaaauggacaaacuccgacucaaaggagucuccuacagccugugcacagcagccuucacauucacaaaaauacccgcagagacccugcacggaaccguaaccguagagguccaauaugccggaaccgacggccccugcaaagucccagcccaaauggcagucgacaugcaaacacucacccccguaggaagacuaaucaccgcaaacccaguaaucaccgaaaguaccgaaaacagcaaaaugaugcuagaacucgaucccccauucggcgacagcuacauagucaucggggucggcgaaaagaaaaucacccaccacuggcaccgcucaggaucaacaauaggaaaagcauucgaggcaaccguacgcggcgccaaacgcauggccguccuaggagacacagcaugggacuuuggcuccguaggaggcgcgcucaacagccucggaaaaggaauacaccaaaucuucggggccgccuucaaaucccuauuuggaggaaugucgugguucucgcaaauccucauaggcacacuccugauguggcucgggcuaaacaccaaaaacggcuccaucagucuaaugugucucgcccucggaggaguccuaaucuuccuaagcacagcuguaagcgca

SEQ ID NO: 2746 - RNA, 2061 nt, Artificial Sequence
  ZIKV (isolate Z1106033) Polyprotein(108-794) CDS opt
accagcgucggaauuguaggacugcuccuaacgacagcaauggcagccgaaguaaccagaagaggcuccgcauauuauauguaccucgaccggaacgacgccggagaagccaucuccuucccaaccaccuuagguaugaacaaaugcuacauccaaaucauggaccucggacacacgugcgacgcaaccauguccuacgaaugcccaaugcuagacgaaggcguagaaccagacgacguagacugcuggugcaacaccaccucgacuuggguaguauacggaaccugccaccacaaaaagggcgaagcacgccgaucacgcagagccgucacccuccccucacacagcacccgaaaacugcaaacacggucccaaaccuggcucgaaagccgagaauauacuaaacaccucauaagaguagagaacuggauuuucagaaacccgggcuucgcccucgccgcggcggcaauagcauggcuccuaggcuccuccacaucgcaaaaagugauauaucucgucaugauacuacucaucgccccagcauacuccauacgaugcaucggcguauccaauagagacuucgucgaaggaaugagcggaggcacguggguggacguaguccucgaacacggcggcugcguaaccgucauggcacaagauaaaccaacgguagacaucgaacucgucacaaccaccguaucaaacauggcugaaguccgauccuacugcuacgaagccuccaucagcgacauggcauccgacucacgcugccccacccaaggcgaggccuaccuggacaaacaaucagacacccaauacgucuguaagcgcacccugguggaccggggcuggggcaacgggugcggacucuucggcaaaggcagccucguaacaugcgcaaaauucgccugcagcaagaaaaugacaggaaaaagcauccaacccgaaaaccucgaauaccgaauaaugcuaagcguacacggaucccaacacuccgguaugauaguaaacgacacaggccacgagaccgacgaaaaccgcgccaaagucgaaauuacccccaauucgccccgagcagaagcuacccuaggaggguuuggcucccuaggacuggacugcgaaccacgcaccggacuagacuucuccgaccuauacuaccucaccaugaacaacaaacauuggcuaguacauaaggaaugguuccacgacaucccacuacccuggcacgccggagccgacacaggcacaccccacuggaacaacaaagaggcacucguagaguucaaagacgcccacgccaaaagacaaaccgucgucguucucggcucacaagaaggcgccguacacacggcccucgcuggugcccuggaagccgaaauggacggagccaaaggacgccucuccagcggccaccuaaaaugccgccuaaaaauggacaaacuccgccucaaaggcguauccuacucacucugcaccgccgccuucaccuucaccaaaauacccgcagaaacgcuccacggcacaguaaccgucgaaguacaguacgcuggaacggauggucccugcaaaguacccgcccaaauggcaguagacaugcaaacccucacccccguaggccgccucaucaccgccaacccaguaaucacagaaucaaccgaaaacucgaaaaugauguuagaacucgacccacccuucggagacucauacaucgucaucggcgucggcgagaaaaagaucacgcaccacuggcaccgcagcggcucaacaaucggaaaggccuucgaagcaaccguaagaggagccaaacgcauggccguacucggcgacaccgcaugggacuucggcuccgucggcggagcacuaaacucccucggcaaaggaauccaccaaaucuuuggcgcagcuuuuaaaucccucuucggcggcaugucaugguucucucaaauccucaucggcacacuccuaauguggcucggguuaaacgcuaaaaacggcuccaucagccucaugugccuagcacucggcggaguacuaauauuccuaucaaccgcaguaucagcc

SEQ ID NO: 2747 - RNA, 2049 nt, Artificial Sequence
  ZIKV (strain MR 766) Polyprotein(108-790) CDS opt
acauccauaggcaucauaggauuacuacuaaccaccgccauggccgccgaaauaacacgccggggauccgcuuacuauauguaccucgaccgcagugacgccggcaaagcuaucagcuucgcaaccacucuaggaguaaauaaaugccacguucaaaucauggaccuaggccacaugugcgacgccacaauguccuacgaaugccccaugcuagacgaagguguagagccggacgacgucgacugcuggugcaauaccaccagcaccugggucgucuacggcacgugccaccacaagaaaggagaagcacgucguucccgacgcgccguuacucugccaagccacuccacccguaaacuccagaccagaucacaaacauggcuagaguccagagaauacaccaaacaccucaucaaagucgagaacuggauauuccgaaaccccggcuucgcccucgucgccgucgcaaucgccuggcuacucggauccagcacuucacagaaagucaucuaccucgucaugauccuacucaucgccccggcuuacagcauccgaugcaucggagugagcaaccgugacuucgucgaaggcaugucuggcgguaccuggguagacgucguccuagaacacggaggcugcgucaccguaauggcccaagacaaacccacugucgacauagaacucgucacaacaaccgucagcaauauggcagaaguccgcuccuacugcuacgaggccuccauaagcgacauggcaucagacucccgcugcccaacccaaggagaagccuaccuggacaaacaauccgacacgcaauacgucugcaaaagaaccuuagucgaccgcggauggggaaacgggugcggccuauucggcaaaggcucgcucguaaccugcgccaaguucacaugcagcaaaaagaugacgggcaaaagcauacaaccggaaaaccucgaauacagaauaaugcucucgguccacggcucccaacacagcggaaugauuggauacgaaacugacgaggacagagccaaagucgagguaaccccaaacuccccgcgcgcugaagccacccuaggaggcuucggaagccugggccuugacugcgaaccccgaacaggacuggacuucucagaccuguacuacuugaccaugaacaacaaacacuggcugguccauaaagaaugguuccacgacaucccccuuccauggcaugcaggcgcagacaccggcacaccccacuggaacaacaaagaagcccucgucgaguucaaggacgcacacgcaaaacgucaaaccguugucguccuaggcucacaagaaggagcaguucacaccgcccucgcgggcgcccuagaggcagaaauggacggagccaaagggcgccucuucagcggccaccuaaaaugccgccuaaaaauggacaaacuccgccugaaaggaguaucguacucccucugcaccgcagcauucaccuucaccaaaguacccgcggagacccuacacggaacaguaaccguugagguccaauaugccggaaccgacggcccaugcaagauccccguacagauggccguagacaugcaaacacugacaccagucggacgccuaaucaccgcaaaccccgugaucacagaguccaccgaaaacagcaaaaugaugcucgagcucgacccaccuuucggcgacagcuacaucgucauaggagucggagacaagaaaauaacccaccacuggcaccgaagcggguccacgaucggcaaagccuucgaagcgacaguuagaggagccaaacguauggccguacuuggcgacaccgccugggacuucggaagugucggcggcgucuucaacucacucggcaaaggaauccaccaaaucuucggagccgcguucaaaucacuauucggaggaauguccugguucucccaaauccuuauaggaacacuccugguauggcuaggucuaaacaccaaaaacggcagcauaucccuaaccugccucgcgcucggcggugucaugauauuccucucuaccgccgucuccgcc

SEQ ID NO: 2748 - RNA, 2061 nt, Artificial Sequence
  ZIKV (strain NatalRGN) Polyprotein(108-794) CDS opt
accaguguaggcaucgucgggcuccuacucaccacggccauggcggcagaggucacccgacguggauccgcauauuacauguaccucgaccgaaacgacgccggggaagcgauauccuucccgaccacccucggaaugaacaaaugcuacauacaaaucauggaccuaggacacaugugcgacgcaacaaugagcuacgaaugcccaaugcucgacgaaggcguggaaccagacgacgucgacugcuggugcaacaccaccuccacauggguaguauacggcacaugccaucacaagaaaggcgaagcccgacgguccagacgcgcugugacacucccaagccacagcacaagaaaacuccaaacacgcucccagaccuggcucgaaagccgggaauauacaaaacaccucauacgcgucgaaaacuggauauuccgcaacccgggguucgcacucgcggccgccgccaucgcauggcuccuuggcagcagcacuucacaaaaagugauauaccucguaaugauccuccugaucgcgcccgccuacuccauccgcugcauaggcgucagcaaccgcgacuucguggaaggaauguccggcggcacgugggucgacgucguacucgaacacggaggcugcgucacaguaauggcccaagacaaaccaacggucgacaucgaacuuguaaccaccacaguaagcaacauggccgaaguccgcucauacugcuacgaggcaagcauauccgacauggcaucagauucacgcugccccacccaaggagaagccuaccuggacaaacaaucagacacacaauacguaugcaaacggacccucguagaccgcggcuggggcaacggcugcggacucuuuggcaaagguucgcucguaaccugcgccaaauucgccugcuccaaaaagaugaccggaaagucaauccaacccgagaaccucgaauaccgaaucaugcucucgguccacgggucccaacacaguggcaugaucgucaacgacacgggacacgaaacagacgagaacagagccaaaguagaaaucacccccaacuccccaagagcggaagcaacacucggcggcuucggcagccuuggccuagacugcgaaccacgaaccggacuggacuucagugaccucuauuaccuaacaaugaacaauaaacacuggcucguacacaaagaaugguuccacgacauaccgcuacccuggcacgcgggugccgacaccggaaccccacacuggaauaacaaggaagcccuagucgaauuuaaagacgcacacgccaagagacaaacagucguaguacuaggcucacaagaaggcgcaguacacacagcccuagcaggagcgcucgaagccgaaauggacggcgcgaaaggccgacugagcagcggccaccuaaaaugccgacuaaaaauggacaaacuacgccuuaaaggagugucauacagccucugcacagcggcauucaccuucaccaagauaccugcagaaacacuucacggcaccguaaccgucgaaguacaauaugccggaacagacggcccaugcaagguacccgcgcaaauggccgucgacaugcaaacccuaacccccguaggacgacuaaucacagcaaaccccgucaucaccgaaucgacagaaaacucaaaaaugaugcuagaacuagaucccccauucggcgacucauacauagucauaggcgucggcgaaaagaaaaucacacaccauuggcaccgauccggaagcacaauaggaaaagcauucgaggcaacaguaagaggcgccaaacgcauggcaguccucggcgacacagcaugggacuucggcagcguaggaggagcacuaaacucccugggaaaaggaauacaccaaauauucggcgccgcauucaaaagccucuucggagggaugagcugguucucccaaauccuaaucgggacccuccugauguggcuaggccuaaacaccaaaaacgggagcaucagccucaugugccuagcacuaggcggcguccuaauauuccuaucaaccgcaguuagcgca

SEQ ID NO: 2749 - RNA, 1353 nt, Artificial Sequence
  ZIKV (strain ZikaSPH2015) Polyprotein(273-723) CDS opt
ucacaaaaagucauauaccuggucaugauccuacucaucgccccagccuacagcauacgcugcauaggaguaucgaaccgagacuuugucgagggcaugagcggaggcacaugggucgacaucguccucgaacacggcgggugcgugacaguaauggcacaagacaaaccgacaguggacauagagcuagucacaaccacggucucgaacauggcagaaguaaggagcuacugcuacgaagccagcauaagcgacauggcaucagacucaaggugcccaacacaaggcgaggcuuaccucgacaaacaaagcgacacccaauacgugugcaaacgcacccuaguagaccgcgguuggggcaacggaugcggccuguucggcaaagggagccuagucacaugcgcgaaauucgccugcagcaagaaaaugacuggaaaaagcauccagccggaaaaucucgaauaccgcauaaugcucagcgugcacgggagccaacacucaggaaugaucgugaacgacaccggacacgaaacagacgaaaacagagcgaaaguagaaauaaccccaaacucaccaagagccgaagccacacuaggaggauucggcucgcuaggccuugacugcgaaccccgaaccgggcuagacuucucggaccucuauuaccucaccaugaacaacaaacacuggcucguccacaaagaaugguuccacgacauaccgcuacccuggcacgcaggcgcagacacaggcacaccccacuggaacaacaaagaggcccucguagaauuuaaagacgcccacgcaaaacgccaaacaguggucguacuagggagccaagaaggggcaguucacacggcccuagccggagccuuagaggcggaaauggacggagcgaaaggacgccucucgagcggccaucuaaaaugucgccugaaaauggacaaacucaggcucaaaggcguauccuacagccuauguaccgccgcguucacauucacaaaaauacccgcagaaacgcuacacggcacaguaacagucgagguacaauacgcaggcacagacgggcccugcaaaguacccgcgcaaauggcgguagacaugcaaacccuaacacccgucggcagacuaauaaccgcaaacccaguaaucacagagagcacagagaacagcaaaaugaugcucgagcucgacccaccguucggagacucauacauagucauaggcgugggcgaaaagaaaauaacgcaccacuggcaccgcuccggaucaaccauaggcaaagccuucgaagccaccguacgaggcgccaaaagaauggccgugcucggagacacagccugggacuucggcucg

SEQ ID NO: 2750 - RNA, 1353 nt, Artificial Sequence
  ZIKV (isolate Z1106033) Polyprotein(273-723) CDS opt
ucccaaaaagucauauaccuaguaaugauacuacucauagccccagcauacagcauccgcugcaucggcguaucaaacagggacuucguagaaggcaugagcggaggaacauggguagacguaguccuagaacacggcggaugcgugaccguaauggcacaagacaaaccgaccguagacauagagcuagucaccacaaccgucuccaacauggcagaagucagaagcuacugcuacgaagcaagcaucagcgacauggccagcgacagccggugcccgacccaaggggaagccuaccuagacaaacagagcgacacacaauacgugugcaaacgcacacucguagaccgcggauggggcaacggcugcggacuguucggcaaaggaagucuagucacgugcgcaaaauucgccugcagcaagaaaaugaccggcaaaucgauccaacccgaaaaccucgaauaccgcaucaugcuaagcgugcacggcagucagcacucggguaugaucgugaacgacacaggacacgaaacagacgaaaaucgcgcaaaaguggaaauaaccccaaacucccccagagccgaggccacccucggaggcuucggcucgcucggacucgacugcgaaccccggaccggccucgacuucuccgaccuguacuaucuaacgaugaacaauaaacacuggcucguacacaaagaaugguuccacgacauacccuuacccuggcacgccggcgcagacacaggaacgccacacuggaacaacaaagaagcccucguggaguucaaagacgcacacgccaagcgccaaaccgucguaguacuaggaucccaagaaggcgccguacacacggcccuagccggagcccuggaagcggaaauggacggagcaaaaggcagacucagcagcggacaccugaaaugccgacugaagauggacaaacuaagacucaaaggcgugagcuacagccucugcacagccgcauucacguucacaaagauacccgcagaaacacuacacggcacaguaacagucgaaguccaauacgccggcacggacgggcccugcaaaguacccgcacaaauggcaguggacaugcaaacgcucacacccgugggaagacuaauaacagcaaacccagucauaacagaaagcacagaaaacagcaaaaugaugcuagaacucgacccacccuucggcgacucguacauagugauaggcguaggagaaaagaaaauuacacaucacuggcaccgcucaggcagcacaauaggcaaagccuucgaagcaacgguccgcggagcaaaacgcauggccgugcucggagacaccgccugggacuucggauca

SEQ ID NO: 2751 - RNA, 1341 nt, Artificial Sequence
  ZIKV (strain MR 766) Polyprotein(273-719) CDS opt
ucgcaaaaaguaaucuaccuagucaugauccuacuaaucgcccccgccuacuccauacgaugcaucggaguaagcaacagagacuucgucgaaggaaugagcggcggaaccugggucgacguaguccuggaacauggcggcugcgucaccgucauggcccaagacaaacccaccguagacauagaacucgucacaacaacaguauccaacauggcugaaguccgaagcuacugcuacgaagccucaauaagcgacauggccucagacagcagaugccccacccaaggagaagcauaccuagacaaacaaagcgauacacaauacguauguaaacgcacacuggucgaccgcggauggggaaacggcugcggccucuucggcaaaggcagucucguaaccugcgccaaauucacaugcagcaagaaaaugaccggaaaauccauacaaccugaaaaccucgaauauagaaucaugcuaucgguccacggaagccaacauucgggcaugaucggcuacgaaaccgacgaagaccgcgccaaaguagaagucacaccgaacaguccccgagcagaagccacccuaggcggcuucggaucccucggccuagacugcgaacccagaaccggauuagacuucagcgacuuauacuaccucaccaugaacaacaaacacuggcucguccacaaagaaugguuccacgacauaccccuaccauggcacgccggcgcagacaccggcaccccgcacuggaacaacaaagaagcccuagucgaguucaaagacgcacacgccaaacgccaaaccguagucguacucggaagccaagaaggcgcaguacacaccgcccuggccggagcccucgaagccgaaauggacggcgccaaagggagacucuucagcggacaccuaaaaugcagacucaaaauggacaaacuccgccuaaaaggcguguccuacucccuaugcacagcagccuucacguucacaaaagugccagccgaaacacuacacggcacaguaaccgucgaaguccaauacgcgggaacagacggcccaugcaaaaucccaguccaaauggcagucgacaugcaaacacucacccccgucggacgacuaaucaccgccaacccagucaucaccgaauccacagaaaacucaaaaaugaugcucgaacucgacccacccuucggagacuccuacaucgucauaggagucggcgacaaaaagaucacccaccacuggcacagaagcggcagcaccauaggcaaagccuucgaagcaacaguacgcggagcaaaacgcauggccguccuaggcgacaccgccugggacuucgggucc

SEQ ID NO: 2752 - RNA, 1353 nt, Artificial Sequence
  ZIKV (strain NatalRGN) Polyprotein(273-723) CDS opt
agccaaaaagucauauaccucguaaugauccuacucauagccccggccuacagcauccgcugcaucggaguaucaaacagagacuucguagaaggcaugagcgggggaacauggguagacguaguccucgaacacggaggaugcguaacaguaauggcacaagacaaaccgaccguagacauagaauuagucacaaccacagucucaaacauggccgaaguccgcagcuacugcuacgaagcgagcauaagcgacauggcaagcgauucaagaugccccacccagggggaagccuaccuagacaaacaaagcgacacccaguacguaugcaaacgaacccucguggaccgcggauggggaaacgguugcggccuauucgggaaagggagccuagucacaugcgcaaaauucgcaugcagcaagaaaaugaccgggaaaagcauacaaccagaaaaccuagaauaccgcaucaugcugagcguacacgggagccaacacucaggaaugaucgucaacgacaccggacacgaaacagacgaaaaccgagccaaaguagaaauaaccccuaacucaccacgagccgaagcgacacugggcggauucggcucgcucggacuugacugcgaaccccggaccggacuagacuucucggaucuauacuaccucacgaugaacaacaaacacuggcucguacacaaagaaugguuccacgacauaccccuacccuggcacgcgggcgccgacacaggaacaccccacuggaacaacaaagaagcacucguagaguucaaagacgcacacgccaaacgccaaaccguagucguacuaggaagccaagaaggcgccguccacacggcacuagccggagccuuagaagccgaaauggacggcgccaaaggccggcuaucaagugggcaccugaaaugcagacugaaaauggacaaacucaggcucaaaggagugagcuacagccugugcacggcagcauucacauucacaaaaauaccagcggaaacacuccacgggaccgucacggucgaaguccaauacgcaggcacagacggacccugcaaaguacccgcgcaaauggccgucgacaugcaaacgcucacaccaguaggcaggcucauaacagcaaacccaguaauuaccgaaagcacagaaaacagcaaaaugaugcuagaacucgacccaccauucggagacucauacauagucaucggcguaggagagaagaaaauaacacaccacuggcaccgaucaggcuccacaaucggcaaagccuucgaggcaaccgucagaggagccaaacgcauggcagugcucggagacacggccugggacuucggcucg

SEQ ID NO: 2753 - RNA, 2061 nt, Artificial Sequence
  ZIKV (strain ZikaSPH2015) Polyprotein(108-794)(F398S) CDS opt
acaagcguaggcauagucggcuuacugcucacgaccgccauggcagcggaaguaaccagacgaggaagcgcauacuauauguaucuggaccgaaacgacgccggcgaagcaaucagcuuccccacaacgcucggcaugaacaaaugcuacauacagaucauggaccucgggcacaugugcgacgccacgaugaguuacgagugccccaugcucgacgagggagucgaaccagacgacgucgacugcuggugcaacaccaccagcaccugggugguauacggcacaugccaccacaagaaaggagaagcacgccgcucucgacgagccguaacacuccccucccacagcaccagaaaacuccagacaagaucacaaacauggcuagaaucacgcgaauacacaaaacaccucauaagggucgaaaacuggauauucagaaaucccggauucgcccucgccgccgccgcgaucgcaugguuacucggcuccuccaccagccaaaaagucauauaccuagugaugauacuccucaucgcuccagcauacuccauccggugcauaggaguauccaaccgagauuuuguggagggaaugucgggaggcaccugggucgacaucguccucgagcacggaggcugcguaacagucauggcacaagacaaacccacagucgacauagagcuaguuaccacaaccguauccaacauggccgaaguaagaucguacuguuacgaagcaagcaucagcgacauggccagcgacagccgcugcccuacccaaggcgaagccuaccucgacaaacaguccgacacacaauacguauguaaacgcacccuagucgacagagguugggguaacggcugcggacucagcggcaaaggcagccucgugaccugcgcgaaauucgccugcucaaagaaaaugaccggcaaauccauacaacccgaaaaccuagaauaccgcaucaugcucucgguccacggaucacagcacucaggcaugauagucaaugacacaggacacgaaaccgacgaaaaccgagcuaaagucgaaaucaccccaaacagcccacgcgccgaagccacgcucggaggcuucggaucacuagggcuagacugcgaaccccgcacaggacuagacuucagcgaccucuacuaccugacaaugaacaacaaacacuggcucguucacaaagaaugguuccacgauaucccccuacccuggcacgcaggagccgacacaggaaccccacacuggaacaacaaggaagcccucguagaguucaaagacgcacacgccaagcgacaaaccgucguaguauuaggcucgcaagaaggcgcaguacacacagcccucgccggcgcacucgaagcagaaauggacggcgccaaagggcgacuaaguagcggccaucucaaaugccgacucaaaauggacaaacuccgacuaaaaggcgucucauacucccuaugcaccgcagcauucaccuucaccaaaaucccggccgaaacacuccacggaaccgucaccgucgaaguacaauacgcaggaacggauggcccguguaaaguucccgcgcaaauggccgucgacaugcaaacgcuuacaccagucggcagacucauaacagccaacccaguaauaaccgaaagcacagaaaauagcaagaugaugcucgaacuagacccacccuucggagacuccuacauaguaaucggcguaggagaaaagaaaaucacccaccacuggcaccgaagcggaagcacgaucggcaaagcauuugaagccaccgugcgcggcgccaagagaauggccguacucggcgacacagccugggacuucgguuccgucggaggcgcacuaaacucacugggcaaaggcauacaccaaaucuuuggagcagccuucaaaagccucuucggaggcaugucaugguucucccagauacucaucggcacccuacucauguggcuaggccugaacaccaagaacgggucaauaucacuaaugugccuagcccucggcggaguacuaauauuccugagcaccgccguaagcgca

SEQ ID NO: 2754 - RNA, 2061 nt, Artificial Sequence
  ZIKV (isolate Z1106033) Polyprotein(108-794)(F398S) CDS opt
acgagcgucggcaucgucggacugcuucucacaaccgcgauggcagccgaaguaacccgcagaggauccgcauacuacauguaccuagaccgaaacgacgccggagaagccaucagcuucccaaccacccugggaaugaauaaaugcuacauacagaucauggaccugggccauaccugcgacgcgaccauguccuaugagugcccaaugcuagacgaaggaguagagcccgaugacgucgacugcuggugcaacacaacuucgaccugggucguguacggaaccugccaccacaagaaaggcgaagcacggcgaucaagacgagccgucacacuaccaagccacagcacccgcaagcuacaaacacgaagccagacauggcuagaaucccgagaguacaccaaacaccuaauccgaguagagaacuggaucuuccgcaacccaggcuucgcacuugccgcggccgcaaucgccuggcugcucggcagcagcacaagucaaaaggucaucuaccuggucaugauacuccuaauagcgccggccuacagcauccguugcaucggcgucuccaaccgagacuucguugaaggcaugucaggaggcacauggguagacguaguacucgagcacggaggcugcguaaccgugauggcgcaggacaaaccaacaguagacaucgagcuagucaccacaaccgugucgaacauggcugaagucaggagcuacugcuaugaagcaucaauaucagacauggcaagcgacuccagaugccccacacaaggcgaagccuaccucgacaaacaaucugacacccaauacgugugcaaaaggacccuaguagaccggggcuggggcaacgggugcggccuaagcggcaaaggcagccuaguaaccugcgccaaauucgcaugcuccaagaaaaugacaggcaaauccauccaaccagaaaaccuagaauacagaaucauguuaucaguccacggaagccaacacucaggcaugaucgucaacgacaccggacacgaaacagacgaaaaccgcgcgaaaguagaaauaaccccaaacucacccagagcagaagccacacugggcggcuucggcucccucggacuggacugcgaaccccgaaccgggcuagacuucucagaccuauacuaccucacaaugaacaacaaacacuggcucguccacaaagaaugguuccacgacaucccacuccccuggcacgcaggcgccgacaccggcacaccacacuggaauaacaaagaagccuuaguggaguucaaagacgcacaugccaaaagacaaaccgucgucguacuaggcagucaagaaggcgcaguacacacagcgcucgcgggcgcgcuggaagccgaaauggacggagcaaaaggcagguuaucaagcggccaccucaaaugccgacuaaaaauggauaaacuacgccucaaaggcguaagcuacagccucugcacagcagcauucaccuucaccaaaauacccgccgaaacacugcacggcacaguaacagucgaaguccaauacgcaggcaccgacggaccaugcaaaguccccgcccagauggccgucgacaugcaaacccucacucccguagggcgcuuaaucaccgccaacccagucaucacagaauccacagaaaacaguaaaaugaugcucgaacucgacccgccuuucggagacuccuacaucguaaucggcguaggcgaaaagaagaucacccaucacuggcacagaucagguagcaccaucggcaaagcguucgaagcaaccgugcgcggcgcgaaacgcauggcaguucucggcgacacugcaugggacuuuggcucaguaggaggcgcacucaacagccuaggaaaaggaauacaccaaauauucggcgccgcauucaaaagccuauucggcggaaugucaugguucagccaaauacucauuggcacccuccucauguggcugggccucaacgccaaaaacggcuccauaucgcucaugugccucgcacuaggcggcguauuaauauuccucucaacagcugucagcgca

SEQ ID NO: 2755 - RNA, 2049 nt, Artificial Sequence
  ZIKV (strain MR 766) Polyprotein(108-790)(F398S) CDS opt
accuccauaggcauaaucggccuacugcuuacgacagcaauggccgcagaaauaacacgacggggcuccgccuacuacauguaccucgaccgcucggacgccggaaaagcaaucaguuucgcuacaacccucggcguaaacaaaugccacguccaaaucauggacuuaggccacaugugcgacgcgacuauguccuacgaaugccccauguuagacgagggcgucgaacccgacgacgucgacugcuggugcaacaccaccucgacauggguagucuacggcacuugccaucacaagaaaggagaagcacgccguucaagacgagcagucacccuacccagccacagcacacgaaaacuacaaacccgcucccaaaccuggcuagaaagccgcgaauacaccaaacaccucauaaaagucgaaaacuggauauuccgaaaccccggcuucgcacucgucgccguagccaucgcauggcuccuaggauccagcaccagccagaaagucauauaccuagucaugauucuacucaucgcaccggcauacuccauacgcugcaucggaguaagcaacagagacuucgucgaagguauguccggcggcacuugggucgacgucguccucgaacacggaggaugcgugacagucauggcacaagacaaaccaacaguggacaucgaacucguaaccaccaccgucagcaacauggccgaaguccgaagcuacugcuacgaagccagcaucagcgacauggcuucagacagccgcugcccaacgcaaggggaagccuaccucgacaaacaaucagacacccaauacguaugcaaacgcacccuggucgaucgcggauggggcaacgggugcggccuuucuggcaaggggucccuaguaaccugcgcaaaauucaccuguucaaagaaaaugaccggcaaauccauccaaccugaaaaccucgaauaccguauaaugcucaguguccacggaucccaacacagcggaaugaucggcuacgaaacagacgaagaccgcgccaaaguagaaguaacccccaacucgccacgagccgaggccacacuaggcgguuucggcucccuaggacucgacugcgaaccucgcacagggcucgacuucuccgaccuauacuaccugacaaugaacaacaaacacugguuaguccauaaggaaugguuccaugacauaccccuccccuggcacgcuggcgccgacacaggcacaccgcacuggaacaacaaagaagcucuaguagaauuuaaagacgcccacgccaaacgacaaacagucguuguccuaggcucccaagagggagcaguacacacagcccuagcgggcgcccuagaagccgaaauggacggcgccaaaggccgccucuucuccggccaccucaaaugucgccucaagauggacaaacuccgccuaaaaggcguaucuuauagccuaugcacagcagcauucacauucacaaaaguaccagccgaaacgcuccacggaacggucacagucgaaguccaauacgccggcaccgacggaccgugcaagaucccaguacaaauggcaguagacaugcagacccuaacaccagucggccgccugauaacugccaacccagucauaaccgaaucgaccgaaaacucaaagaugaugcuugagcuugacccacccuucggcgacuccuacauuguaaucggcgucggggacaagaaaaucacccaccacuggcacagaagcggauccaccauaggaaaagccuucgaagcaaccguaagaggagccaaaagaauggcaguccucggcgauacagcuugggacuucggaagcgucggaggcgucuucaacucccucgguaaaggcauccaccaaauauucggcgcagcauucaagucccuguucggcggaaugucaugguucucacagauacuaaucggaacacugcuaguauggcuaggccucaacaccaaaaacggcagcaucagccuuacgugccuagcacugggcggagucaugaucuuucucuccaccgccguauccgcc

SEQ ID NO: 2756 - RNA, 2061 nt, Artificial Sequence
  ZIKV (strain NatalRGN) Polyprotein(108-794)(F398S) CDS opt
acaucaguagggauaguaggacuccuccugacaacagccauggccgccgaagucacaagacguggcagcgcguacuacauguaccuggauagaaacgacgcaggcgaagcaaucaguuuccccacaacacugggcaugaacaagugcuacauccaaaucauggaccugggccacaugugcgaugccaccaugagcuacgaaugccccaugcuagacgaaggcgucgaacccgacgacgucgacugcuggugcaacacaacaaguacgugggucguguacggcacaugucaccacaaaaagggagaagcucggcggucccgccgagccgucacgcuccccagccacagcacaagaaaacuccaaacacgaagccaaacauggcuagaaucaagagaauacaccaaacaccucauaagaguggaaaacuggaucuucagaaacccaggcuucgcacuagccgcagccgcaaucgcgugguuacuuggcuccagcacuucucagaaagucauauaccugguaaugauacuacuaauagccccggcauacucgauacgaugcaucgggguaaguaacagggacuucgucgaaggaauguccggaggcacauggguagacguaguccuagaacacggcggaugcguuacgguaauggcccaagacaaaccaaccguagacaucgaacuggucacaacaaccguaagcaacauggcagaggucagaagcuacugcuacgaagccucaauaagcgacauggcaagcgauucccggugcccaacucaaggggaagcauaccuagacaaacaauccgacacacaauacguaugcaaacgcacacuuguagacagaggcugggggaacggcugcggacuauccggaaaaggcucguuagugacaugugcaaaauucgcaugcagcaagaaaaugacagggaaaucaauacaacccgaaaaccuagaauaucggaucaugcucuccguacacggcucacaacacagcggaaugaucguaaacgacaccggacacgaaacagaugaaaaccgagcuaaaguagaaaucacccccaacagcccaagagcagaagcaacacucggaggauucgguucacuuggacucgacugcgagcccagaaccggccucgacuucucagaccuauacuaccuaacgaugaauaacaaacacuggcucguacacaaagaaugguuccacgacauaccccugccguggcacgcaggggcggacacaggaaccccacacuggaacaacaaagaagcgcuggucgaguucaaagacgcccacgcuaaacgccaaaccguaguaguacucggaagccaggaaggagccguacacaccgcccuggccggggcacucgaagcagaaauggacggcgccaaaggccgccuaagcagcggacaccuaaaaugccgucugaaaauggacaaauugcgacucaagggaguauccuacucccuuugcaccgcagcauucacauucacaaaaauacccgccgaaacacuacauggcacaguaacaguagagguccaauacgcaggcacggacgguccaugcaaaguacccgcgcaaauggccgucgacaugcaaacacugacuccagucggcagacucauaaccgcaaaccccguaauaaccgaaaguaccgaaaacagcaaaaugauguuagagcuagacccacccuucggcgacagcuacauaguaauaggagucggcgagaaaaagauaacccaccacuggcaccgcagcggaagcaccaucggcaaagccuucgaagccacaguccgcggggccaaacgaauggcaguccugggcgacacagcaugggacuucgggucagucggcggcgcacuaaacagccucgggaaaggcauacaccaaaucuucggugcagcuuucaaaagccuauucggugggaugucaugguucagccaaauacucauaggcacccuccucauguggcugggccucaacaccaaaaacggcucaauaagccuaaugugccuagcacuaggcggcguccugauauuccuguccacagccguauccgcc

SEQ ID NO: 2757 - RNA, 2061 nt, Artificial Sequence
  ZIKV (strain ZikaSPH2015) Polyprotein(108-794)(N444Q) CDS opt
accagcgucggaauagucggacuccuccucacaacagcaauggccgcggaagucacccgacgcggcagcgcuuacuacauguaccucgaccgaaacgacgccggcgaagccaucagcuuccccaccacccugggcaugaacaaaugcuacauacaaauaauggaccuuggccacaugugcgacgcgaccaugagcuacgaaugccccaugcucgacgaaggaguggagccagacgauguagacuguuggugcaacacaacaucaaccugggucgucuacggcacaugccaccacaagaagggagaagccagacgcagccgcagagcaguaacccuaccgucccacucuaccagaaaacuccaaacacgaagccagacaugguuagaaagccgcgaauacacaaaacaccucaucagagucgagaacuggauauucagaaacccaggcuucgcauuagccgcagccgcaaucgccuggcuccuagggagcucaaccucacaaaaaguaauauaccuagucaugauacuacucauagccccggccuacagcauacgaugcauaggugucucaaacagggacuucgucgaaggcaugagcggaggcacguggguggacauaguacucgaacacggcggcugcgugaccgucauggcacaagacaaaccgacaguagacauagaauuggugacaaccacagucuccaacauggccgaagugcguucauacugcuacgaagcaagcaucagcgacauggccucagacagccgaugcccaacccaaggcgaagccuaccuagacaagcaaagcgacacacaauacgucugcaagcggacgcuaguggaccgaggcuggggcaacggcugcggacuauucggcaaaggaagccucguaacaugcgcgaaauucgcgugcagcaagaaaaugaccggcaaauccauccaacccgaaaaccucgaauacagaauuaugcucuccguacacggcagccaacacuccggcaugauuguacaagauacaggccacgagacagacgaaaacagagcgaaagucgaaauaacccccaacucgccccgggccgaagcaacucuaggaggauucggaucgcuagggcuugacugcgaaccccgaacaggacuagacuucuccgaccuguacuaccuaacaaugaacaacaaacacuggcuaguacacaaagaaugguuccacgacauccccuuacccuggcacgcaggcgccgacacaggaaccccacacuggaacaacaaagaagccuuaguggaguucaaagacgcacacgcaaaacgccaaaccguaguaguacuaggaagccaagaaggagcaguacacacagccuuggccggagcguuagaagccgaaauggacggggcaaaaggcaggcuuagcucgggacacuuaaaaugcagacuaaaaauggacaagcuccgccugaaaggaguauccuacucccuaugcacagccgcguucacauucacgaaaauacccgccgaaacuuuacacggcacggucacagucgagguccaauacgcaggcaccgacgggccaugcaaaguacccgcccaaauggccgucgauaugcaaacccuaaccccaguaggaaggcuuauuaccgccaacccagucauaacagaaagcacagaaaacucaaaaaugaugcuagaacuagauccacccuucggagacuccuacaucgucauaggcguuggagaaaagaaaaucacacaccacuggcacagaucaggaagcaccauaggcaaagccuuugaagcgacaguacgcggcgcaaagagaauggccguacuuggcgacacagccugggacuucggcucagucgggggcgcgcugaacagccuaggcaaagggauacaccaaauauucggagcagcauucaaaucccucuucggcggaaugucaugguucucacaaauccucaucggaacccuacugauguggcuaggccuaaacaccaaaaacggcagcaucucacucaugugccuggcccuaggcggaguccucaucuuccucuccaccgccguaucggcc

SEQ ID NO: 2758 - RNA, 2061 nt, Artificial Sequence
  ZIKV (isolate Z1106033) Polyprotein(108-794)(N444Q) CDS opt
accagcguaggaaucgucgggcuacuacucacaacagcaauggcggccgaggucacccgcagaggauccgccuacuacauguaccuagaccgaaacgacgcaggcgaagcgaucagcuucccaacuacacuaggaaugaacaaaugcuacauacaaauaauggaccuuggacacacaugcgacgccaccaugagcuacgaaugcccaaugcuggacgagggaguugagcccgacgauguggacugcuggugcaacaccacgagcacguggguugucuauggcacaugccaccacaagaaaggcgaagccagacgcagccgacgcgcaguaacacucccaucacacucaacaagaaaacuucaaacaagaagccaaaccuggcuggaaagccgagaauacacaaaacaccugauacgagucgaaaacuggaucuuccggaaccccggauucgcacucgcggcugcagccaucgccuggcuacucggcuccagcacaucccaaaaagucaucuaccucgugaugauauuauugauugcacccgcauacucaaucagaugcaucggcguaagcaaucgugauuucguggaggggaugucaggcggcaccuggguggacgucguacuagaacacgggggaugcgucacaguuauggcccaagacaaaccaacagucgacaucgaacugguaaccacaaccguaagcaauauggccgaggugcgaucauacuguuacgaggccagcauaagcgacauggcuucagacucccgcugccccacccaaggagaagcguaccuagacaaacaaucagacacacaauacguaugcaaaaggacccuagucgaccgaggauggggcaacggaugcgggcuauucggcaagggcagccuaguaacuugcgccaaauucgcaugcuccaagaaaaugacaggcaaaagcauacaaccagaaaaccuagaauacagaaucaugcuaucgguacacggaagccaacacagcgggaugauaguacaagacacgggacacgaaacagacgaaaacagggccaaaguagagauaacgcccaacaguccccgggcagaagcaacacuaggcggcuucggaucacuaggccuagacugcgaaccacgcacaggccuagacuucagcgaccucuacuaccucaccaugaacaacaaacacuggcugguacauaaagaaugguuccacgacauaccguuaccguggcacgcaggcgcagacaccggcacaccccacuggaacaacaaagaggcccucguagaguuuaaagacgcccacgcaaaacggcaaacagucguaguccuaggaucgcaagagggcgcaguccacacagcacuagcaggcgcccuagaagccgaaauggacggagccaaaggacgacucuccuccggccaccuaaaaugcagacucaagauggauaaacuccgacuaaaaggcgucuccuacucgcucugcacagcggcauuuacauucaccaaaauaccagccgaaaccuuacacggaaccguuaccgucgaaguacaguacgcaggaacagacgggccaugcaaagucccggcacagauggccgucgacaugcaaacccucaccccagucggccgacucaucacggccaaccccgugaucacagaaucgaccgaaaauucaaaaaugaugcuagaacuugacccacccuucggagacagcuacaucgucauaggcgucggcgagaagaaaaucacccaucacuggcaccgcagcggaagcaccauaggaaaggccuucgaggcaaccgugagaggagcgaaacgaauggccguacucggcgacacugcaugggacuucggcuccgucggcggagcucuaaacucccugggaaaaggaauccaccaaauauucggagccgccuucaaaagccuauucggaggaauguccugguucucacaaauacuaauaggcacccuccugauguggcuaggacuaaacgcaaagaacggguccauaagccugaugugccuggcgcucgggggcguccuaaucuuccuauccacagcaguauccgca

SEQ ID NO: 2759 - RNA, 2061 nt, Artificial Sequence
  ZIKV (strain NatalRGN) Polyprotein(108-794)(N444Q) CDS opt
acaagcguaggaaucgucgggcuccugcuaacgacagcaauggcagcagaagucacucgacgaggcuccgcauacuacauguaccuggaccgaaacgacgccggagaagccauauccuucccaaccacacuuggcaugaacaaaugcuauauccaaauaauggaccucggacacaugugcgaugccacaaugucauacgaaugcccaaugcucgacgaaggcguggaaccagaugacgucgacugcuggugcaacaccacaagcaccugggucguauacgguacaugccaccacaagaaaggcgaagcacggaggagccgacgagcaguaacccuaccaagccacuccacucgcaaacuccaaacccgaagccaaaccuggcuagaaagccgagaauacaccaaacaccuaauacggguagaaaacuggaucuuccgaaaucccggcuucgcacuagccgccgcggcaaucgcauggcucuuaggcucaaguacaagccaaaaaguaaucuaccucgucaugauucuacuaaucgcccccgccuacuccauacgcugcaucggaguaagcaacagagacuucgucgaagggaugucaggcgguaccuggguggacgucguacuagaacacggcggcugcguaaccgucauggcccaagacaaaccaacgguagacaucgaacucgucaccaccacagucagcaacauggccgaagugcgcuccuauugcuaugaagcaucaauaucagacauggcuucagacucacgaugcccaacacaaggagaagccuaccuagacaaacagucagacacccaauacguaugcaaacgaaccuuagucgaucgcggauggggaaacggcugcggccucuucgggaaaggcucgcuagugacaugcgccaaauucgcaugcuccaagaaaaugaccggcaaaucaauccaaccagagaaccuagaguauaggauaaugcucucaguccacggaucgcaacauagcggaaugauaguccaagacacgggacacgagacggacgagaaccgcgcaaaagucgaaauaacaccaaacagcccccgagcggaagcgacacuaggcggguucggaagccuaggacuagacugcgagccacgaacgggccuggacuucucagaccuauacuaccucaccaugaacaacaaacauuggcuaguccacaaagaaugguuccacgacaucccccucccauggcacgcgggugcagacacaggcacuccccacuggaacaacaaagaggcccuggucgaauuuaaagacgcucacgcgaaaaggcaaaccgucguaguacugggcucacaagaaggcgcgguccauacagcccucgcaggcgcauuagaagccgaaauggacggagcaaaaggacgccuauccucaggccaccucaaaugccgacucaaaauggacaaacuacggcugaaaggaguauccuacagccucugcacagccgcauucaccuucaccaaaauccccgccgaaacccuacacgggaccguaacaguagaaguacaauacgcagggacagauggcccaugcaaagucccggcccagauggccgucgacaugcaaacacuaacaccgguuggacgccucaucacagccaaccccgucauuacagaaucaacagagaacuccaaaaugaugcucgaacuagacccacccuucggagauucauacaucgucauaggcgucggagaaaagaaaauaacucaccacuggcaccgcagcggcagcaccaucggcaaagcauucgaagccacaguccgaggagcaaaaaggauggcaguacucggagacaccgcaugggacuuugguagcgucggcggcgcccuaaacucacuaggaaaaggaauacaucaaaucuucggagcagcauuuaaaagccucuucgguggaaugagcugguucucccaaauacuaaucggaacccuccugauguggcuaggacugaacaccaaaaacggaagcaucagccugaugugccucgcgcucgggggcguacuaaucuucuuaagcacagcaguaucggcc

SEQ ID NO: 2760 - RNA, 2061 nt, Artificial Sequence
  ZIKV (strain ZikaSPH2015) Polyprotein(108-694)-Cterm-JAEV1-E(400-500) CDS opt
acaagcguuggaaucgucgggcugcuacucacgaccgccauggccgcugaagucacgcgcaggggcucagcauacuacauguaccucgacagaaacgacgcgggcgaagcaaucagcuucccaacaacacucggcaugaacaaaugcuacauacaaauaauggaccucggacacaugugcgacgcaacaaugucguacgaaugccccaugcucgacgaaggaguugaacccgacgacguagacugcuggugcaacacaacaaguaccugggucguguacggaaccugccaccacaagaaaggagaagcuaggcggucacgacgcgcaguaacccugccaagccacuccacgagaaaacuacaaacccgcagccaaacauggcuggaaucacgcgaauacaccaaacaccucauccgcguggaaaacuggauuuucagaaacccaggcuucgcgcuagccgccgccgccauagcauggcuacucgggucauccacaagccaaaaagucauauaccucgucaugauccuguuaaucgccccagcguacagcauacggugcaucggcgucagcaaucgagacuucguggaaggcauguccggcggaaccugggucgacaucguccucgagcacggagggugcguaaccgucauggcacaagacaaaccaacaguagacauagaacucgugacaacaacaguaucuaauauggccgaaguccgcuccuacugcuacgaagccagcaucucagacauggccuccgacucacgcugcccaacgcaaggggaagcauaccucgacaaacaauccgacacccaauacguaugcaaaagaacacucguagaccgaggguggggaaacggaugcggccuauucggaaaaggcagccucguaaccugcgccaaauucgcgugcuccaagaaaaugacgggcaaaagcauccaacccgaaaaccucgaauacagaaucaugcuguccguccacggcucccaacacuccgggaugaucguaaacgacacgggacacgaaaccgacgaaaaccgagccaaaguagaaaucaccccaaacagucccagagccgaagccaccuugggugguuucggaagccucggccucgacugcgaaccgagaacaggccuggacuucagcgaccucuacuaccucacaaugaacaacaaacacugguuaguccauaaagaaugguuccacgacauaccucuccccuggcacgccggcgcagacaccggaaccccacacuggaacaacaaagaggcacuuguagaguucaaagacgcccacgccaaacgacaaaccgucguaguccucggaucacaagaaggcgcgguacacaccgcacucgcgggggcccuggaagcagaaauggacggcgccaagggcagacucagcuccgggcaccucaaaugcagacugaaaauggacaagcuccgacucaagggagucucuuacucacuaugcaccgccgcguucacauucacuaaaaucccagccgaaacacuccacgguaccgucaccguagaaguccaguaugcaggcacugacggcccgugcaaagugcccgcccaaauggccguagacaugcaaacacucaccccaguaggaaggcuaaucacugcaaaccccgugauaacagaaucaaccgaaaacucaaaaaugaugcuagaacuagacccacccuucggagacuccuacaucgucauaggagugggggaaaagaaaaucacacaccacuggcacagguccggcuccacacucggcaaagccuucuccaccacccuaaaaggcgcacaacgccuagcagcccuaggagacacggcgugggacuucggguccauaggcggcguauucaacuccaucggacgcgcaguccaccaagucuucggcggagccuuccgaacccuauucggcggaaugagcuggauaacccagggacugaugggagcacuacugcuauggaugggcgucaacgcacgcgacagaagcauagcacuagccuuccucgccacuggcggaguacucguauuccuggcaacaaacguccacgca

SEQ ID NO: 2761 - RNA, 2061 nt, Artificial Sequence
  ZIKV (isolate Z1106033) Polyprotein(108-694)-Cterm-JAEV1-E(400-500) CDS opt
accagcgucggaaucgucggacuccugcuaacaacagcaauggcagccgaagucacgcgaaggggaucggcauacuacauguaucucgaccgcaacgacgcgggcgaagccaucagcuucccaacaacgcugggcaugaacaaaugcuacauacaaauuauggaccuaggacacacaugcgacgcaacaaugagcuacgaaugccccaugcucgacgagggcguugaacccgacgacgucgacugcugguguaauacgacauccacauggguaguauacgggaccugccaccacaagaaaggggaagcgcgccgguccaggagggccgucacucucccgagccacaguaccaggaaacuacaaacccgcagccaaaccuggcucgaaagccgugaauauacaaaacaccuaauucgcguagagaacuggaucuuccgcaaccccggauucgcccuggcagcagcagcaauagccuggcuguugggcucaagcacaagccaaaaggucauauaccugguaaugauccuacuaauagcaccagcauacuccaucagaugcauaggcgugagcaaccgagacuucguugaaggaaugucgggcgggacaugggucgacguaguccuagaacacggaggcugcguaacggucauggcucaagacaagcccacggucgacauagagcuaguuacuacaacaguaagcaacauggccgaagucaggagcuauugcuacgaagccuccaucucagacauggcauccgacucccggugccccacccaaggagaagcauaccucgacaaacaaagcgacacgcaauacgucugcaaaaggacccucgucgaccgcggauggggcaacggaugcgggcuauucggaaaaggaucccucgugaccugcgccaaauucgccugcuccaagaaaaugacaggcaaaagcauacaacccgagaaucuggaauacagaauuaugcucagcguacacggcucacagcacagcggcaugaucguaaacgacaccggacacgaaacggacgaaaaccgagcaaaagucgaaauaacaccaaacagcccucgcgcggaagcgacccugggaggauucgggagccuaggacuggacugcgaaccccgcacgggccuagacuucagcgaucucuauuaccuaaccaugaacaacaaacacuggcuagugcacaaagagugguuccacgacaucccacucccguggcacgccggagccgacacaggaaccccgcacuggaacaacaaagaggcccuuguagaguucaaagacgcacaugcgaaaagacaaacagucguaguccugggcucacaagaaggagccguacacacagcacuagcaggcgcucucgaagccgaaauggacggagccaaagggcgccuaagcuccggccaccugaaaugccgccuaaaaauggacaaacuacgccucaagggaguaucauauucccuaugcaccgcagccuucacauucacaaaaaucccagccgaaacacuacacggcacaguaacagucgaaguacaauacgcaggaacagacggcccaugcaaaguccccgcccaaauggcgguugacaugcaaacccuaaccccagucggacgccugaucacagcaaacccagucaucaccgaauccacagagaacucaaaaaugaugcucgaacuagacccgcccuucggcgauagcuacaucguaauagggguaggagaaaagaaaaucacacaucacuggcaccgcagcggaagcacccuaggcaaagcauucucgaccacacugaaaggagcacaacggcucgcagcccucggagacaccgccugggacuucggauccauagggggagucuucaacucgaucggccgcgcaguacaucaaguauucggcggcgcguucaggacacuauucggaggaaugagcuggaucacacaaggccuaaugggagcccuacuacucuggaugggcgucaacgcacgagaccggagcauagcccuagcauuccucgccaccggaggcguacucguauuccuagcaacgaacguacacgcg

SEQ ID NO: 2762 - RNA, 2049 nt, Artificial Sequence
  ZIKV (strain MR 766) Polyprotein(108-690)-Cterm-JAEV1-E(400-500) CDS opt
accagcaucggaauaaucggacuccuccuaacgaccgcaauggcagcagaaauaacacgacgaggcucagccuacuacauguaccuggaccgcagugacgcaggaaaagcgaucucguucgcaacuacccucggcgucaacaaaugccacguccaaaucauggaccucggucacaugugcgacgcaaccauguccuacgaaugcccaauguuagaugaagguguagaaccagacgacguagacugcuggugcaacacgacgucaaccugggucgucuacgguaccugccaucacaagaaaggcgaagcccgccgcagcagacgcgccguaacccuaccaagccacucaacacgaaaacuccagaccagaucacagacguggcuggaaucccgagaauauaccaaacaccuaauaaaagucgaaaacuggauauucagaaaucccggauucgcccucgucgcaguagcaaucgcuuggcuacucggauccagcacaagccaaaaaguaaucuaucucguaaugauacuccuaauagcacccgcauacuccauaagaugcaucggcguaagcaaccgagacuucgucgaaggaaugucgggcggcacauggguagacgugguacuagagcacggaggauguguaacggucauggcacaagauaaaccgaccgucgacauagaacucguaacaaccaccguauccaacauggccgaagucagaagcuacuguuacgaagccuccaucucagacauggccucagacucccgcugccccacacagggcgaagcauaccuagacaagcaauccgacacacaauaugucugcaaacgaacgcuagucgaccgaggaugggggaacggaugcggacucuuugguaagggcucacucguaaccugcgccaaauuuaccugcagcaagaaaaugaccggaaaaagcauccaaccggaaaaccuagaauacagaauuaugcucucgguccacggcucacaacacagcgggaugauaggcuaugaaaccgacgaagacagagccaaaguagaggucacaccaaacagccccagggcagaagcaacccucggcggcuucggaucccucggccucgacugugaaccccgaaccggccuggacuucuccgaccucuacuaccugaccaugaacaacaagcacugguuaguucacaaagaaugguuccaugacaucccccuacccuggcacgccggcgcagacaccggcaccccacacuggaacaacaaagaagcccuagucgaguucaaagacgcacacgccaaacggcaaacagucguaguccuuggcucccaagaaggagccguacacaccgcacucgccggagcacuagaagcagaaauggacggugccaagggccgacucuucagcggacaccuaaaaugccgccucaagauggacaagcuaagacucaaaggggucuccuacucucucugcacugcagccuucaccuucacgaaaguccccgcagaaacccuccacgggacugucaccguagaaguacaauacgccgguaccgacggcccaugcaaaaucccaguacaaauggcaguagacaugcagacacuuacacccguaggacgccuaauaacagcaaaccccgucauaaccgaaagcacagaaaacuccaaaaugaugcuagaacuagacccucccuucggagacagcuacauagugaucggcgucggcgacaagaaaaucacacaccacuggcacagaagcggcagcacccuaggcaaagcauucucuacaacccucaaaggcgcccaacgacuagcagcacucggagacacagccugggacuucggaagcaucggaggcgucuucaacagcauaggacgcgccguacaccaagucuucggaggcgcuuuccgcacccucuucggcggaaugagcuggaucacccaagggcugaugggcgcacuacuacucuggaugggaguaaacgcacgggacagaagcaucgcccuggcuuuucucgccaccggcggcguccucgucuuccuagcaacgaacguacaugcc

SEQ ID NO: 2763 - RNA, 2061 nt, Artificial Sequence
  ZIKV (strain NatalRGN) Polyprotein(108-694)-Cterm-JAEV1-E(400-500) CDS opt
accuccgucggcauaguaggccuacuacucaccaccgccauggccgccgaagucacgcgcagaggaagcgcauacuacauguaccuggaccgaaacgaugccggcgaagcgaucuccuucccaaccacucucgggaugaacaaaugcuauauccaaaucauggaccuaggacacaugugcgaugcaaccauguccuacgagugcccaaugcuagaugaaggagucgaaccagacgacguggacugcuggugcaacaccaccucgacauggguagucuacggcacaugccaccauaagaagggggaagccagacgcuccagacgagcaguaacgcuccccucacacucaacgagaaaacuccaaaccagaagccagacauggcucgaaucacgcgaguacaccaaacaccucauccgcgucgaaaacuggaucuuccgaaauccuggcuucgcccuagcagcagccgccauagccuggcuacucggcagcagcaccagccaaaaaguaaucuaucuaguaaugauccuacuaaucgcacccgccuacagcauacgcuguaucgguguaucaaaccgcgacuuugucgaaggaaugucaggcggcacaugggucgacguaguccuagaacacggcggcugcgucacaguaauggcacaagacaaaccaacggucgacauagagcuaguaacaacaacgguauccaacauggccgaaguccgaucauacugcuacgaagccuccaucucagacauggcaucggacucccgcuguccgacacaaggagaagcguaccuagacaaacaaucggacacccaauacguaugcaaacgaacucuaguagaccgcggcuggggaaacggauguggccucuucgguaagggcucacucgugaccugcgcaaaauucgcaugcagcaagaaaaugaccggcaaauccauccaaccugaaaaccuagaauaccgaauaaugcuaucaguccacgguucacaacacuccggaaugaucguaaacgacaccggccacgaaacagacgaaaaccgagccaaaguagaaauaacccccaacagcccacgagcggaagcaacccuagggggauucggcucacuggggcuggacugugaacccagaacgggccuagacuucagcgaccucuacuaccuaacaaugaacaauaaacacuggcuaguacacaaagaaugguuccacgacaucccccuccccuggcacgcaggcgccgauaccggcacuccccacuggaacaacaaagaagcucuggucgaguucaaagaugcacacgcuaaaagacaaaccguagucguccuaggcucccaggaaggugcgguccacaccgcccucgcaggagcccucgaggcagaaauggacggcgcuaaaggacgccuaagcuccggccaccucaaaugccgccuaaaaauggacaaguuacgccucaaaggagugaguuacagccucugcacagcggccuucaccuucacaaaaaucccagcagaaacacuacacggaaccgucaccgucgagguucaauacgcaggcacggacgggccaugcaaagucccagcccaaauggccgucgacaugcaaacucuaaccccaguaggccgccucauuacagccaacccaguaaucacugaauccaccgagaacagcaaaaugaugcucgaacucgacccaccauucggggacuccuacaucgucaucggcguaggcgagaagaaaauaacacaccacuggcaccgcucggggagcacucucggcaaggccuucucaaccacacucaaaggcgcccaacgacucgccgcccuaggagacaccgcaugggacuucggcucaaucggcggagucuucaacagcauaggccgcgccguacaccaaguauucggcggagcauuccgcacacuguucgggggaauguccuggauaacacaaggccucaugggcgcccuauuacuuuggauggggguaaacgcccgagaccgaagcauagcccuagccuuccuagccaccggagggguacucguauuuuuagccaccaacguccacgca

SEQ ID NO: 2764 - RNA, 2136 nt, Artificial Sequence
  ZIKV (strain ZikaSPH2015) Polyprotein(93-804) CDS opt
cgcaucauaaacgcccgcaaggaaaagaaaagacgcggggccgacacauccgucggaauaguaggccugcuacuaacaaccgccauggccgccgagguaacaagacgcggcagcgccuauuacauguaccucgaccgcaaugacgcaggagaagcaauaucauuccccaccaccuugggaaugaacaaauguuacauccaaaucauggaccuaggacacaugugcgacgcaacaaugaguuacgagugcccaaugcuggacgaaggaguggaaccagacgacgucgacuguuggugcaacaccaccagcaccuggguaguauacggcacaugccaccacaagaaaggcgaagcacgacgaagccggagagcgguaacccuccccagccacuccacacgcaaacugcaaaccagaucccaaaccuggcuagaaagccgcgaauacacaaaacaucucauacgcguggaaaacuggauauuuagaaacccaggcuucgcccuagccgccgccgcaaucgcauggcuccucggaagcuccaccagccaaaaaguuauuuaccugguaaugauacuguugauagcacccgccuacagcauucgguguaucggcguaagcaacagagacuucgucgaaggaaugucgggaggcaccugggucgacaucguccuagagcacggcggcugcguaaccgucauggcacaagacaaaccaacagucgacaucgagcucgucaccaccaccguaucaaacauggccgaagugcgcagcuacugcuacgaagcaagcauaucagacauggcuucugacagcagaugccccacacaaggagaggccuaccuagacaagcaauccgacacacaguacguaugcaaacgaacccuagucgaccgaggauggggaaacggaugcggauuauucggcaagggaucccuagucacgugcgcaaaauucgccugcagcaagaaaaugaccggaaaauccauacaaccagaaaaccucgaauacaggauaaugcucagcguacacggcucacaacacaguggcaugaucgucaacgacaccggacaugaaaccgacgaaaaccgcgccaaaguggaaaucaccccaaacagcccacgggcagaggcaacacucggcggcuucggcucccuaggacuggacugcgaacccagaaccggacucgacuucuccgaccucuacuaccuaacaaugaacaacaaacauuggcuggugcacaaagaaugguuccacgacauaccgcuucccuggcacgccggcgccgacacgggaacaccccacuggaacaacaaagaagcccucguagaguucaaagacgcacacgcaaaacgacaaacggucgucguccuagggucacaagaaggcgccguccacaccgcacuagccggcgcacucgaagcagaaauggacggcgccaaaggacgacucucaucaggccaccuaaaaugccgccuaaaaauggacaaacuacgccugaaaggcgucagcuacagccuauguaccgccgcauuuacguuuaccaaaauacccgcagaaacacuccacggcacagucacagucgaaguccaauacgccgggaccgacggccccugcaaaguaccggcccagauggcaguggacaugcaaacgcucaccccaguuggaagacugauaaccgcaaaccccgucaucaccgagagcaccgaaaacucaaaaaugaugcuagaacucgacccacccuucggcgacuccuacaucgucaucggcgucggugaaaagaaaauaacacaucauuggcacagauccggaagcaccaucggaaaagcauucgaagccaccguccgaggagcaaaaagaauggcgguccucggcgacaccgcgugggacuucggaagcgugggcggcgcccucaacagccuagggaaagggauacaccaaauuuucggugcagccuucaaaucacuauucggcggaaugagcugguucucccaaauacuaaucgguacacuacucauguggcuaggccuaaacaccaaaaacggcagcauaagccuaaugugucucgcucuaggcggcguacucaucuuccucucuacagcagucagcgccgacguaggcugcagcgucgacuucagcaaa

SEQ ID NO: 2765 - RNA, 2133 nt, Artificial Sequence
  ZIKV prME variant CDS opt
aucaucaaugcucgaaaagagaagaaacgacguggcgcagacacaucggucggcauaguaggacucuuacucacaaccgcaauggcagcggaagucacccgacgcgggagcgccuacuacauguaccucgaccgcaacgaugccggugaggcaaucucauuccccacgacacuaggaaugaacaaaugcuacauccaaaucauggaccucgggcacaugugcgaugcgacuauguccuaugagugcccaaugcuggaugaaggagucgaacccgacgacguagacugcuggugcaacacgaccaguacaugggucguauacggaacgugccaccacaagaaaggcgaagcccgccgcagccgucgagcagugacccuacccagccacucaacacgcaaacuccaaacacguucacaaaccuggcucgaaagccgagaauacacgaaacaccuaauaagagucgaaaacuggaucuuuaggaacccgggcuucgcacuagcagcggccgcgauagccuggcuccuggggagcucgaccucacaaaaagucauauaccugguaaugauccuacugaucgccccggcauacucuauacgcuguauaggcgucucgaaccgcgacuucguagaaggaaugagcggagggacaugggucgacauaguccuagaacacgggggcugcguaacagucauggcccaagacaaaccaaccgucgacaucgaauuagucacaacuacagucucgaacauggccgaaguacggagcuacugcuacgaagccagcaucagcgacauggccucagacagccgaugcccaacacaaggcgaagcauaccucgacaaacaaagcgacacacaguacguaugcaaacgcacccuaguagacagaggauggggaaacgguugcggacucuucgggaaaggaagccuagucacaugcgcaaaauucgccugcagcaagaaaaugacuggcaaaaguauacaaccagaaaaccucgaauaccgaaucaugcucagcgugcacggaucacaacacucugggaugauaguaaacgacaccggacaugaaaccgaugaaaaccgcgccaaaguagagaucacaccaaacagccccagggccgaagccacccucggaggcuucggcagccugggacuagacugcgaaccccgcacaggccucgacuucucagaucuauacuaccucacaaugaacaacaaacacuggcuaguccacaaagaaugguuccacgacaucccucuaccguggcacgccggcgcagacaccggcaccccacacuggaacaacaaagaagcccuaguggaguucaaagacgcacacgcaaagcgccagacaguaguaguacuagggagccaagaaggagcaguccacacagcacucgccggggcccuagaagccgaaauggacggcgcaaagggacgccuguccucgggacaccuaaaaugccgacugaaaauggacaagcuccgacuaaaaggcguaagcuacagucuaugcacagccgcguucacauucaccaaaaucccugcagagacgcugcacgggaccguaacaguagaaguacaauacgccggcacggacgggcccugcaaaguaccagcacaaauggccgucgacaugcagacacucacacccguaggcagacuaaucacagcaaaccccguaaucaccgagucgacagaaaacaguaagaugaugcuggaacucgacccacccuucggagacuccuacauaguaauaggcgugggugaaaagaaaaucacacaccacuggcaccgaagcggaagcacaauaggcaaagccuucgaagcaacaguaagaggggcaaaacgcauggccguccucggcgacacagcgugggacuucggaagcgucggaggcgcacucaacucccucggaaaaggaauccaccaaauauucggagcagccuucaaaucccuauucggcgggaugaguugguucagccaaauacugauaggcacccugcuaauguggcuaggacucaacaccaaaaacgggucaauaucacucaugugccucgcgcuaggaggagucuuaaucuuccuaucaacagcugucagcgccgauguaggaugcuccguugacuuuucaaaa

SEQ ID NO: 2766 - RNA, 2130 nt, Artificial Sequence
  ZIKV prME variant CDS opt
aucaacgcaaggaaggagaagaaacgccgaggggccgacacgagcgugggcauagucggccuccuacucacaaccgcgauggcggcagagguaacaagaagaggcagcgccuacuacauguaccucgaccgcaacgacgcaggagaagcaauaucauucccaaccacccuaggcaugaacaaauguuacauacaaaucauggaccuaggccacaugugcgacgccacaauguccuacgaaugcccaaugcuagacgagggcguagagcccgacgacgucgacugcuggugcaacaccacuagcaccugggugguauauggcacuugccaucacaagaaaggagaagcccgccgcuccaggagagcaguaacccuccccagccacagcacaagaaaacuccaaacaagaucccaaacuuggcuggaaucgagagaauacaccaaacaucuaauaagagucgagaacuggaucuuccgaaacccaggauucgcacuagccgcagcagcaauagccuggcuucuaggcucaagcacaucccagaaaguaaucuaccuagucaugauacucuugauagcaccagcauacucaauccgcugcauaggaguaagcaaccgcgacuucgucgaaggaaugagcggaggcacaugggucgauaucguacucgagcacggaggcugcguuacggucauggcacaagacaaacccaccguagacaucgaacugguaaccacaacagugagcaacauggcagaaguacgcagcuacuguuacgaagcaucaaucucagacauggcaucagacagccgaugcccaacacaaggcgaagcguaccucgacaaacaaagcgacacacaauacguauguaaacggacccuggucgaccgaggauggggcaacggaugcggacuguucggcaaaggaucgcucguaacaugcgcaaaauucgcaugcagcaagaaaaugaccggaaaaagcauacaacccgagaaccucgaauaccggaucaugcucucgguacacgggucccaacacagcggcaugauaguaaacgacacgggacacgaaacagacgagaacagagcgaaagucgaaauaacaccaaacagcccccgagcagaagcgacccugggcggcuucgggucccugggacuagacugcgaaccaagaacuggacuagacuuuuccgaccuauacuaccuaaccaugaacaacaaacacuggcugguacacaaagaaugguuccaugacaucccgcucccauggcacgccggggccgauaccggcacaccccacuggaacaacaaagaagcccuagucgaauuuaaagacgcccaugccaaaagacaaacagucgucguacugggcagccaagagggcgccguacacaccgcgcucgcaggcgcacuagaagccgaaauggacggagcaaaaggaagacuaagcucaggccaccuaaaaugcagacucaaaauggacaaacugcgccugaaaggagugucguacucccuaugcacagcagccuucaccuucacaaaaaucccagcagagacgcuacacgggacagucaccguagaggugcaauaugcagggacagacggcccaugcaaaguacccgcccaaauggccguagacaugcaaacccuaacaccagucggacgccucauaacagcaaacccaguaauaacagaaucuacggagaacucgaaaaugaugcuggaacuagauccgcccuucggcgacagcuacaucguaauaggagucggugaaaagaaaauaacacaccacuggcacagauccggcagcacgauaggaaaagccuucgaggcaacaguaaggggcgccaaacgaauggcaguacuaggcgacaccgccugggacuucgggucagucggaggggcacuaaacagucucgggaaaggcauacaccaaauuuucggagccgccuucaaaagccuauucggaggaaugucgugguucucacaaauccuuauaggcacgcuacuaauguggcuugggcuaaauaccaaaaacggcagcaucagccugaugugccuagcacucggaggcgugcucauauuccucagcaccgccgucagcgcggacgucggaugcagcguggacuucagcaag

SEQ ID NO: 2767 - RNA, 2127 nt, Artificial Sequence
  ZIKV prME variant CDS opt
aacgcgcgaaaagaaaagaaaaggcgaggggccgacacaagcguuggaaucgucggccuacucuugacaacggcaauggcagcagaaguaacacggcgcggaucagcguacuacauguaccucgacagaaacgacgccggcgaagccaucagcuuccccacgacccucggcaugaacaaaugcuauauacaaaucauggaccucggccacaugugcgacgcaacaaugagcuacgaauguccaaugcucgacgaaggggucgaaccagacgacguagacuguuggugcaacacaacgagcacauggguaguauacggaacaugccaccacaagaaaggcgaagccagacgcagccgaagggcaguaacacuccccagccacucaacacgcaaacuccaaacccgaucacaaacguggcuagaaucccgugaauacaccaaacaccuuauacgcgucgaaaacuggaucuuccgcaauccaggguucgcacucgccgcagcagccaucgcguggcugcuaggauccagcacaucgcaaaaaguaaucuaccuaguaaugauccuccuaauugccccggcguacucaauccgaugcauaggagucucaaaccgggacuucguagaaggcaugagcggaggcacauggguagacauuguccuagaacacggcgggugugucaccgucauggcccaagacaagccaaccguggacaucgaacucgucacaacaaccguaucuaacauggcagagguaagaucauacugcuacgaagccaguauauccgacauggcaagcgauuccagaugcccaacccaaggcgaagccuaccuagauaaacaaucagacacccaauacguaugcaaacgcaccuuagucgaccgaggcuggggcaauggaugcggccucuucgggaaaggaagccuagucacuugugcgaaauucgccugcagcaagaagaugacaggcaaauccauccagcccgaaaaccucgaauaccgaaucaugcuaagcguacacggcagccaacacucuggaaugauagucaacgacacugggcacgaaacagacgaaaaccgcgcgaaaguggaaaucaccccaaacucacccagagccgaagccacacuaggaggcuucgguucacucggacucgacugcgaaccaagaaccggccuugacuucucagaccuauauuaucuaacaaugaacaacaagcacuggcuggugcacaaagaaugguuccacgacauaccucucccguggcacgcaggcgcagacacaggaacaccacacuggaacaacaaagaagcccuagucgaguucaaagacgcacacgccaaacgacagacuguagucgugcuaggaagccaagaaggagccgugcacacugcccucgcaggggcacuagaagcagaaauggacggagccaaaggaagacuaagcagcggacaccugaaaugcagacuaaaaauggacaaacuaaggcucaaaggagucaguuacucacuaugcacagccgcguucacauucacaaaaauacccgcagaaacgcuccacggaacagucacaguugaaguccaauacgcaggcacagacggccccugcaaagugcccgcccaaauggcaguagacaugcaaacacucacgcccguagggagacuaauaacggcaaacccggucauaaccgaaagcaccgaaaacagcaaaaugaugcucgaacucgauccgccguucggcgauagcuacaucgucauaggagucggcgaaaagaaaaucacacaccacuggcacagauccggauccacaaucggaaaagccuucgaagccacagugcgaggagccaaacguauggcgguacucggcgacacggccugggacuucggcagcgucgggggagcacugaacagccuaggaaagggaauccaccaaaucuucggagccgccuuuaaaagucucuucgggggcaugucaugguucagucaaauacucaucggaacacuacucauguggcuaggccuaaacaccaaaaacggauccauaucacuaaugugccuugcccuaggcggaguccuaauauuccucucaacagcagucagcgccgacgucgggugcucggucgacuucucaaaa

SEQ ID NO: 2768 - RNA, 2124 nt, Artificial Sequence
  ZIKV prME variant CDS opt
gccagaaaagagaaaaagagacgaggagcggacacguccgucggcaucgucggucuccuucugacaaccgccauggccgcggagguaacccgccgcggaagcgccuacuauauguaccucgacagaaacgacgccggagaagcaaucucauuccccacaacccuaggaaugaacaaaugcuacauccaaaucauggaccucggccacaugugcgacgccacaaugagcuacgagugccccaugcuagacgaaggaguagagcccgacgacgucgacugcuggugcaacaccaccucaaccuggguagucuacggaacaugccaccacaagaaaggcgaggcaagacgcucccgccgagccguuacgcuuccgucacacagcaccagaaaacuccaaaccagaucccagaccuggcucgaauccagagaauacacuaaacaccuuauacgagucgagaacuggaucuucaggaacccaggcuucgcguuagcagcagccgcgaucgccuggcuacucggcaguuccaccagccaaaaaguaauuuaccucgugaugauccuacuaaucgcaccggcauauucuauaagaugcauaggcgucagcaacagggacuucguggaaggaaugucaggaggcaccugggucgauaucguacuagaacacggaggcugcgucaccgucauggcccaagacaaaccaacggucgacaucgaauuagucaccacaaccguaagcaacauggcagaagucagaagcuacugcuacgaagcauccaucuccgacauggcaagcgacucacgcugccccacccaaggcgaagcauaccucgauaaacaaagcgacacacaauacguaugcaaaaggacacucguggacagaggaugggggaacggcugcggccuauucggcaaaggaagccucgugaccugcgccaaauucgcaugcuccaagaaaaugaccggaaaaucaauccaaccagaaaaucucgaauacagaaucaugcucuccguccacgggucccaacacagcggcaugauaguuaacgacacaggccaugagaccgacgaaaaccgggcuaaaguagagauaacccccaacucaccccgggccgaagccacgcuagggggcuucggaagccuaggacucgacugugaaccgcguacgggacucgacuucuccgaccuguauuaucucacaaugaacaacaaacacuggcuaguacacaaagagugguuccacgacauaccgcuaccauggcacgccggcgccgacaccggaacaccacacuggaauaacaaagaagcccucguagaguucaaagacgcgcacgcaaaaagacaaaccgugguagucuuaggcucacaggaaggggcaguacacacagcccuggcaggagcacuagaagccgaaauggauggagcaaaagggcgacuaagcagcgggcaccuuaaaugccgacucaaaauggacaaacuacgccucaaaggagucuccuacucgcuauguaccgccgcauuuacauucaccaaaauccccgcagaaacccuccacggaacaguaacaguagaaguccaauaugccggcacagauggcccaugcaaaguaccugcgcaaauggcagucgacaugcaaacacuaacgccugucggccgacuaaucacagccaacccaguaaucacagaaucgaccgaaaacagcaagaugaugcuagaacuagacccacccuucggcgacuccuacauagucauagggguaggagaaaagaaaaucacucaccacuggcacaggagcggcuccaccauaggaaaagcguucgaagcuaccgucagaggcgcaaaacgcauggcgguacugggagacaccgcaugggacuucggaagcgucggaggggcccuaaacucccuaggaaaaggaauccaccaaauauucggagccgccuucaaaagccuauucggaggcaugagcugguuuucccaaauacuaaucggcacccuccucaugugguuaggacuaaacaccaaaaacggcagcauaucacucaugugccucgcgcuaggcggcguccucauauuccucagcacagcagugucggccgacgucggcugcagcguagacuuuucaaaa

SEQ ID NO: 2769 - RNA, 2121 nt, Artificial Sequence
  ZIKV prME variant CDS opt
agaaaagagaagaaacgaagaggagcagacaccagcguaggaauagucggacuccuccuaacuaccgcaauggcagcagaagucacgcgaagaggcagcgcguacuacauguaccuagaccggaacgaugccggcgaggccaucucauucccaacaacacucgggaugaacaaaugcuacauacagaucauggaccucgggcacaugugcgacgccacuauguccuacgagugcccgaugcuggacgaaggcgucgagccagacgacgucgacuguugguguaacacuaccagcaccuggguaguauacggaacaugccaccacaagaaaggagaagcccgcaggagcagacgcgcggucacgcugccaucccacagcacgcgcaaacuccaaacuaggucacaaaccuggcuagagagccgagaauacaccaagcaccuaaucagagucgaaaacuggauauuccgcaacccaggauuugcacuagcggccgccgcaauagcguggcuacuaggcucgagcacaucccaaaaagugaucuaccuagucaugauacuccuaaucgcacccgcauacagcauccgaugcauaggagucucuaacagagauuucgucgaaggaaugucgggcggaacgugggucgacauaguacuagaacacggaggcugcguaaccgugauggcccaagacaaaccaaccgucgacaucgagcuagucacgacuaccguaagcaacauggcagaaguacgauccuacugcuacgaagcaagcaucucagacauggccagcgacagccgaugccccacccagggcgaagcauaccuagacaaacaaucagacacacaauacgucugcaaaagaacacucguagaucgcggauggggcaacggaugcggacucuucggaaaaggcagucuagucacaugcgccaaauucgcaugcucaaagaaaaugaccgguaaauccauacaaccagaaaaccucgaauaccggauaaugcucucaguacaugggagccaacacagcggcaugauagucaacgacacagggcacgaaacugacgaaaaccgcgccaaaguagaaauaacaccaaacagcccccgcgccgaagccacacugggaggcuuuggaagccucggcuuagauugcgagccacgaacaggccuagacuucucggaccuauacuaccucacgaugaacaacaaacacuggcuaguacauaaagaaugguuccaugacaucccccucccauggcacgcuggcgcggacacggggacaccacacuggaacaacaaggaagcccugguagaguucaaggacgcccacgcgaaaaggcaaacagucgugguauuaggcagccaggaaggcgccguccacaccgcauuagccggcgcccuggaagccgaaauggacggagcaaaaggcagauuaagcuccggacaccucaaaugccggcuaaagauggacaaacucagauugaaaggaguauccuacagccuuugcaccgcagccuucaccuucacgaaaauaccagccgaaacacuacacggaacaguaacggucgaagugcaauacgcaggaacagacggccccugcaaaguaccagcgcaaauggcagucgacaugcaaacccugacgccggucggcagacuaaucaccgcaaacccagucaucacagaauccaccgaaaacucaaaaaugaugcuagaacuggacccacccuucggagacuccuacauuguaauaggagucggcgaaaagaaaauaacccaccacuggcaccgaucaggcagcacaauaggcaaagcauucgaagccaccguaagaggcgcaaaacgcauggcaguacugggagacaccgcaugggacuucggcagcguuggcggagcccucaacuccuuaggcaaaggaauccaccaaauauucggagcagcauucaaaagccuguuuggcgguaugagcugguucucccaaauacucaucgggacacugcugauguggcucggacucaacacgaaaaacgguagcauaagucugaugugccucgcccuaggcggcguacucaucuuccuaaguacagcgguaucagcagacguaggcugcagcgucgacuucagcaaa

SEQ ID NO: 2770 - RNA, 2118 nt, Artificial Sequence
  ZIKV prME variant CDS opt
aaagaaaagaaacgccgaggcgcagacaccaguguaggcauaguaggacuucuccuaacaacagccauggcggcggaaguaacucgcagaggcuccgccuacuacauguaucucgaccgaaacgacgcgggugaagcaaucagcuucccaaccacucucggcaugaacaaaugcuacauccaaaucauggaccucggccacaugugcgacgccacaaugagcuaugaaugccccaugcuagacgaaggcguagaacccgacgacguagacugcugguguaacaccaccucaaccugggucgucuacggaacgugccaccauaagaaaggagaagcacgccgcagcagacgcgcggucacauuaccaagccauagcacgcgcaaacuacaaacccggucacagacauggcucgagagccgagaguacaccaaacaccuaauacgcgucgaaaacuggauauuccgaaaccccggauucgcacuugcagcggccgccaucgcauggcuccugggcucaagcaccagccaaaaaguaaucuaccuagucaugauccugcuaaucgccccagccuacagcaucaggugcauaggcgugagcaaccgagacuucgucgaaggaaugucgggcggaaccuggguagacaucguacuggaacauggcggcugcgucaccguaauggcccaagacaagcccaccgucgacauagaacucgucacaacuaccgucuccaacauggccgagguacgcuccuacugcuacgaagccucaaucuccgacauggccagcgacucacgaugcccuacgcaaggcgaagccuaccuggacaaacaaucggacacacaauacgugugcaaacgaacauuagucgaccgaggaugggggaacggcugcggccuguucggcaaaggcucauuagugaccugcgcaaaguuugccugcagcaaaaagaugaccggaaaauccauacaaccagaaaaccuagaauacagaaucaugcugucaguacauggcucacaacacagugguaugaucgucaacgacacgggccacgaaacagacgaaaaccgagcgaaaguagaaaucaccccaaacagcccgcgcgcugaagccacacucggagguuucggcucacuaggccuagacugcgagccacgaacuggccuugacuucuccgaccuguacuaccucaccaugaauaacaaacacuggcuaguacacaaagaaugguuccacgacaucccacuacccuggcacgccggcgccgacaccgggaccccacacuggaacaacaaagaagcacugguagaguucaaagacgcccacgccaaaagacaaaccgucguaguacuaggcagccaagaaggugcgguccacaccgcccuagccggcgcccuagaagccgaaauggacggugccaaaggccgccuuagcuccggucaccuaaaaugccgacuaaaaauggacaaacugagacuaaaaggcgucucauacucauuaugcacagcagccuuuacuuucacaaagaucccagccgagacgcuacacggaacaguaacaguagaaguacaguacgccgggaccgacggccccugcaaaguccccgcccaaauggccguagacaugcagacacuaaccccagucgggagacugaucaccgccaacccgguaauaacagaaagcaccgaaaacuccaaaaugaugcuugagcuagacccaccuuucggggauagcuacaucgucaucgggguaggcgagaagaaaauaacacaucacuggcauagaagcggcagcacgauaggaaaagcauucgaagcaacaguccgcggcgcaaaacgcauggccguuuugggcgacacagcaugggacuucggcuccgugggcggcgcacucaacuccuuaggcaaaggcauccaccagaucuucggggccgccuucaaaucacuauucggcggcaugucaugguucagccagauccucauaggcacacuccuaauguggcugggacuaaauaccaaaaacggcuccaucucacucaugugccuugcccucggaggcguccuaaucuuccuuaguacagccguaagcgccgacgucggaugcuccguagacuucuccaaa

SEQ ID NO: 2771 - RNA, 2115 nt, Artificial Sequence
  ZIKV prME variant CDS opt
gaaaagaaaagacgcggcgccgacacgagcgucgguauaguaggacuucuacucacgaccgccauggcggccgaaguaaccagacggggcagcgccuacuacauguaucucgaccgcaacgacgccggcgaagccaucucguuccccaccacacuagggaugaacaaauguuacauccaaauaauggaccucgggcacaugugcgacgcgacaaugaguuacgaaugcccaauguuagacgaaggcguagaaccggacgacgucgauugcugguguaacaccacaucaaccuggguagucuacgggaccugccaccacaaaaagggcgaagcccgaagaucacggagagccguuacccuaccgagccacuccacaagaaaauuacaaacacgaagccagaccugguuagaaucaagagaguacacaaaacaccugauaagaguagagaacuggaucuuccgaaacccgggcuucgcacuagccgccgccgcaaucgccuggcuccuaggauccucaaccagccaaaaagucauuuaccucguaaugauccuccucauagcaccagcauacuccauccgaugcaucgguguuuccaacagagacuucguagaaggcaugucgggcggcaccugggucgacaucguccuagagcacggaggcugcgugacugucauggcacaagacaagcccaccgucgacaucgagcuaguaaccacaacaguauccaacauggcugaaguccgaagcuacugcuacgaagcaucaaucucugacauggccagcgacagccgaugccccacacaaggagaagccuaccuagacaaacaaagcgacacccaauacgucugcaagcgcacccuagucgaccgcggauggggaaacgggugcggacucuucgggaagggaagccuaguaacaugcgccaaauucgcgugcucaaagaaaaugacgggcaagaguauccagcccgaaaacuuagaauacagaaucaugcucucgguucacggaucccaacacagcggcaugauaguaaacgacaccggccacgaaacagacgaaaacagggcaaaaguagaaaucacccccaacucacccagagccgaagccacgcucggcggcuucgggucacucgggcucgacugcgagccccgaaccggacuugacuucagcgaccuuuacuaccuaacaaugaacaacaagcacugguuagugcacaaagagugguuccacgauaucccacuccccuggcacgcaggcgcagacaccgguacaccccacuggaacaacaaagaagcacucguagaguucaaagaugcccacgcaaaaaggcaaaccgucguaguauuaggcagccaagaaggcgcaguacacaccgcccucgccggagcccuagaagcagaaauggacggcgcaaaaggaagacucuccucaggccaccucaaaugccgauugaagauggacaaacuucgacucaagggagucaguuacucauuaugcacugcagccuucaccuucaccaaaaucccggcagaaacgcuacacggaaccguaaccgucgaaguccaauaugcaggcaccgacggcccgugcaaaguacccgcccagauggcggucgacaugcaaacgcugacaccgguaggucgccucauaaccgccaaccccguuauaacggaauccaccgaaaacuccaaaaugaugcucgaacuagacccgcccuucggagacagcuacaucgugaucggugucggagaaaagaaaauaacccaccacuggcacagaagugggagcacaaucggaaaagccuucgaagccaccgucagaggcgccaaacgcauggccguccucggcgacacagcaugggacuucgggagcgucggcggugcccuaaacagccucggcaaaggcauacaccaaauauucggagcagcuuucaagagcuuauucgggggcaugagcugguucucccaaauccuaaucgggacccuacucauguggcucggacuaaacaccaaaaacggaagcauuagccucaugugccuggcccucgggggcguacucaucuuccugucgaccgccguaagcgcugaugucggaugcuccguagacuucucaaaa

SEQ ID NO: 2772 - RNA, 2112 nt, Artificial Sequence
  ZIKV prME variant CDS opt
aagaaacgacggggcgcagacacauccgucggcaucguaggacuccugcuaaccacagcaauggcagccgaagucacacgcaggggcucugcauacuauauguaccuagaccggaacgacgcaggagaagccauaucguucccaaccacacugggaaugaacaaaugcuauauacagauuauggaccucggccacaugugcgacgccaccaugagcuacgaaugcccuaugcucgacgagggcguggaaccagacgacgucgacugcuggugcaacacgacaagcaccuggguggucuacggaaccugccaccacaagaaaggcgaggcgagacgcucccgacgcgcggucacccucccaagccacucaacgcgcaaacuacagacaagaucccaaacauggcucgaaagccgcgaauacaccaaacaccuaauccgagucgaaaacuggaucuuccgcaaccccggauucgcacuagccgccgccgcaauagcauggcucuuaggcucaagcaccagccaaaaaguaaucuaccucguaaugauccuucucaucgcaccagccuauucaauaagaugcauaggaguuagcaacagagacuucguagaaggaaugucgggaggaaccugggucgacaucguccucgagcacgggggcugcgucaccgucauggcucaggacaaaccaacagucgauaucgagcuagucaccacgacaguaagcaacauggcagaaguacgguccuacugcuacgaagcaucgaucuccgacauggcaucagacucacgaugcccaacccaaggcgaagcauaccuagacaagcaaucagacacgcaguacguaugcaagcgaacacugguagacagaggcuggggcaacggaugcggccuauucggaaagggcucacugguaaccugugcaaaauucgcaugcucaaagaaaaugacaggaaaaagcauacaacccgaaaaccucgaguaccguauaaugcucucaguccacggaagccaacauuccggcaugaucguaaacgacacaggacacgagaccgacgaaaacagagccaaagucgaaaucacgcccaauagcccacgcgccgaagccacccuaggaggcuucggaucacuaggauuggacugcgaaccacguaccggccuagacuucucagaccuauacuaccuaaccaugaauaacaaacacugguuagugcacaaagagugguuccacgacauaccacucccauggcacgcgggcgcggacacaggcacaccccacuggaacaacaaagaagcccuaguagaguucaaagacgcacacgcaaaacggcaaaccguaguaguccugggcagccaagaaggcgccguacacaccgcgcuggccggagcccucgaagcagaaauggacggcgcgaaaggaagacuauccuccggccaccuaaaaugccgacucaaaauggacaagcuaaggcugaaaggcgucagcuacucccucuguaccgcagcguuuaccuucaccaaaaucccagcagaaacccuccacggaacagugacaguagaaguccaauacgccggcacagauggcccuugcaagguaccagcgcaaauggcggucgacaugcaaacacuaacaccggucggccgccucauaacagccaaucccguaaucacagaaagcaccgaaaacagcaaaaugaugcucgaacuagacccgccauucggcgacagcuacaucgugauaggagucggcgaaaagaaaauaacacaucauuggcacagaagcggcuccacaaucggcaaagcauucgaagcaacaguaagaggcgccaaacgaauggcaguccugggugacacagcgugggauuucgggucagucggaggugcccuuaacagccuaggaaaagggauccaccaaauauucggggccgcauucaaaucacuuuucgggggaauguccugguucucccaaauccucaucggaacacuccuaauguggcucggacucaacaccaaaaacggcagcaucagccucaugugccucgcacucggaggcguacuaauauuccugucaacggcaguuagcgcagacguagggugcucagucgacuucagcaaa

SEQ ID NO: 2773 - RNA, 2109 nt, Artificial Sequence
  ZIKV prME variant CDS opt
aagaggagaggggcggacaccagcgucggcauagucggccuacuacucacgaccgcaauggccgccgaaguaacacguagaggaucggccuacuacauguaccucgacaggaacgacgccggagaagccaucucauuccccacaacacugggaaugaacaaauguuacauccaaaucauggacuuaggacacaugugcgacgccaccaugucauacgaaugccccaugcucgacgaaggcguggaacccgacgacgucgacugcugguguaacacaacaucaaccuggguagucuacggcacaugccaccacaagaaaggcgaagcccgucgcagcagaagggcaguaacccucccaagccacucaacgcggaaacugcaaacccgaagucaaaccuggcuggaaucgagggaauacacaaaacaccuaauccgaguagaaaacuggaucuuccgcaauccaggcuucgcacucgccgcagcagccauagccuggcuacucggcagcuccacaagccaaaaaguaauuuaccucgucaugauacuacugaucgcccccgccuacuccaucagaugcaucggcgucucaaaccgcgauuucgucgaaggcaugucagguggcaccuggguagacaucguccucgaacacggaggcugcgucaccgucauggcacaagacaaacccacagucgacaucgaauuggucacaaccaccgucagcaacauggccgaaguacgaagcuacugcuacgaagcgucaauauccgacauggcgagcgacucccgauguccaacucaaggagaagcguaucucgacaagcaaucggacacccaauacguauguaaacgaacccuaguagaccgcggauggggcaacggaugcggccuauucggaaaaggcucccucgugacaugugcaaaguuugccugcagcaagaaaaugacaggcaaaagcauccaaccagaaaaccuagaauaccgaaucauguugucaguacacggcucccaacacaguggaaugauagugaacgacacaggccacgaaacagacgagaaucgcgccaaagucgagauaaccccuaacucaccacgcgcagaagcgacacugggaggauucgggucccuaggccucgacugcgaaccacgcaccggcuuagacuucagcgaucucuacuaccuaaccaugaacaacaaacacuggcucguacacaaagaaugguuccacgauaucccacuccccuggcacgccggcgcugacacaggcacgccccacuggaacaacaaagaagcgcuuguggaguucaaggacgcccacgcaaaaaggcaaaccgucguaguacuaggcucacaagagggcgccguacacaccgcccuggcaggcgcacucgaagccgaaauggacggcgccaaaggacggcucuccagcggacaccucaagugccgccuaaaaauggacaaacugagacuaaaaggcguaucauacagccugugcaccgccgcauucaccuucaccaaaauacccgcggaaacccuacacggcacaguaaccguagaaguacaauacgcaggcaccgacggccccugcaaaguaccggcccagauggccguagacaugcaaacccucacucccgucggacgccucaucacagcaaaccccgucauaacagaauccaccgaaaacagcaaaaugaugcucgaacucgacccacccuucggagacuccuacauaguaaucggagucggcgagaagaaaaucacccaccacuggcaucgaucaggaucaacgaucggcaaagcauucgaagcaaccgugcggggagcaaaaaggauggccguacucggcgacaccgccugggacuucgggucagucgggggcgcccuaaacucccugggaaaaggcauucaccaaaucuucggugccgccuucaaaagccuguucgggggcaugagcugguucagccaaauacucauaggcacacuccugauguggcuaggccucaacaccaagaacggcagcaucaguuuaaugugccuagcccugggaggaguccucaucuuccucagcacagccguaucagcagacguaggcuguagcgucgacuucagcaaa

SEQ ID NO: 2774 - RNA, 2106 nt, Artificial Sequence
  ZIKV prME variant CDS opt
cgccggggcgcagacacaucagugggcaucguaggccuccugcucaccaccgcgauggccgcagaggucacccgacgcgggagcgccuacuacauguaccuagaccgaaacgaugccggcgaagccaucucguucccgacaacccugggcaugaauaaaugcuacauccaaauaauggaccuaggucacaugugcgacgcaacuaugucuuacgaaugcccgaugcucgacgaggguguggaaccugaugacguagacugcuggugcaacaccacaagcacaugggugguauacggaacaugccaccacaagaaaggcgaagcacgacggagccggcgcgcagucacccuaccgagccacucaacccgaaaacuccaaacccgcagccaaacaugguuggaaagccgcgaauacacaaaacaccuaauccgcgucgaaaacuggaucuuccgcaacccgggcuucgcccucgcagccgcagccaucgccuggcuuuuaggcucauccaccucacaaaaaguaaucuaccuagucaugauccuacucauagccccugcauacuccaucaggugcauaggcguauccaacagggacuucgucgaaggcaugagcggcggcaccugggucgacaucguacucgaacacgggggcugcguaacagucauggcacaagacaaacccacagucgacaucgaacucgugacaaccacagucagcaacauggcagaaguaagaucauacugcuacgaagcauccauaagcgacauggcaucugacagcagaugcccaacacagggagaagcauaccucgacaaacaaagcgacacacaauacgucuguaaacgaacccuaguagaccgcggauggggaaacggcugcggacucuucggaaaaggcagccucguaacaugcgccaaauucgccugcagcaagaaaaugaccggcaaauccauacaacccgaaaaccucgaguacagaaucaugcuuucaguccacggaagccaacauuccggcaugauagucaacgacaccggacacgaaaccgacgaaaacagagcgaaagucgaaaucacacccaacucacccagggcggaagcaacacugggaggauucgggucacucggucuugauugugaaccccgaacuggacucgacuucuccgaccucuacuaccucaccaugaacaacaaacacuggcuaguccacaaagagugguuccacgacaucccacuacccuggcacgcaggagccgacacaggcaccccacacuggaacaacaaagaagcacuggucgaguucaaagacgcacacgccaaacgccaaacugucgucguacuaggcagccaggaaggagcaguccacacagcacuggccggagcucuagaagcagagauggacggcgcgaaaggacgccuaagcucaggccacuuaaaaugccgacucaaaauggacaaacuccgucuuaaaggagucucguacucacugugcaccgcugcauucaccuuuaccaagauccccgcggaaacccuacacggaaccgucacaguagaaguccaauacgccggaacugacggcccaugcaaaguccccgcccaaauggcaguggauaugcaaacccuaacccccguaggacgccuaauaacagccaaccccguuaucaccgaauccaccgaaaacucuaaaaugaugcuggaacuagauccacccuucggagacuccuauauaguaaucggcgucggagaaaagaaaaucacgcaccacuggcaccggagcggcucaaccaucggaaaagccuuugaggcgaccguccgcggagccaaacgcauggcaguacucggagacacagccugggacuucgggagcgucggaggcgcccuaaacucacucggcaaaggcauccaccaaaucuucggagccgcauucaaaucccucuucggcggcaugagcugguucucacagauacuaauaggaacccuccuaauguggcucggccucaacaccaaaaacgguagcaucagccuaaugugccuagcacuaggcggcguacuaauauuccucuccaccgccgucagcgccgacgugggcuguuccgucgacuucuccaaa

SEQ ID NO: 2775 - RNA, 2103 nt, Artificial Sequence
  ZIKV prME variant CDS opt
agaggcgccgauacuagcguaggaaucgugggacuccuacucacaacugcaauggccgcagaagucacaagacgaggaagcgcauacuacauguaucuagaccggaacgacgccggagaagcaaucagcuucccgacaacacuaggaaugaauaaaugcuauauccaaauaauggaccuaggccacaugugcgacgcgaccaugagcuacgagugccccaugcucgaugaaggcgucgaaccagacgacgucgacugcuggugcaacacuacaagcacauggguaguauacgggacaugucaccacaagaaaggagaagccagacgcucgcgccgcgcagucacacuccccucacacucaacacggaaacuacaaacgcgcucgcaaaccugguuggaaucccgagaauacaccaaacaccuaauccgcgucgaaaacuggaucuuccgcaacccggguuucgcacucgcagccgcagccaucgccuggcuacucggcagcucaacaagccaaaaagucauauaccuaguaaugauacuacugaucgcaccagccuacagcaucagaugcaucggcgucucaaaccgcgacuucgucgaaggaauguccggcggaaccuggguagacaucguacuagaacacggcggaugcgucaccgucauggcacaagacaaacccacaguagacauugagcucguaacaacaacagucuccaacauggccgagguccgaucauacugcuacgaagcauccaucagcgacauggccagcgacuccaggugcccgacccaaggcgaagccuaucucgacaaacagagcgacacgcaguacgucugcaaacgaacauuagucgaccgaggcuggggaaacggaugcggccuauucggaaaaggaagccuagucacgugcgcaaaauucgcaugcucaaagaaaaugaccggaaaaucgauccaacccgaaaaccuggaauaccgaauaaugcucuccguacacgggagccagcacucaggaaugauagucaaugacaccggccacgaaacagacgagaaucgagcuaaaguagagauaacacccaacagccccagagcagaagcgacccucggcggcuucggcucccucggcuuagacugcgaaccacgcaccggccucgacuucagcgaccuauacuauuuaacaaugaacaacaaacacuggcuagugcacaaagaaugguuccacgacauaccacuaccauggcacgcaggggcagacacggggaccccacacuggaacaacaaagaagcccuaguagaguucaaagacgcacacgcaaaacgacaaacaguagucguacuugggagccaggaaggcgcaguccacaccgcacuagccggggcccucgaagcagaaauggacggggcaaaaggcagacuaagcagcggacaucugaaaugcagacucaaaauggacaaacuccgccuaaaaggcguguccuacucacuaugcaccgcagccuucaccuucacgaaaaucccagcggaaaccuuacacggcaccgucacaguggaaguacaauacgccggcaccgacggaccaugcaaaguaccagcacagauggccgucgauaugcaaacacugacgcccgucggacgacugaucacugcaaacccgguaaucaccgaaagcacagaaaacucaaaaaugaugcucgagcucgacccucccuucggagacagcuacaucgucaucggagucggagaaaagaaaauaacucaucacuggcaccgcagcggaucaaccaucggcaaagccuucgaagcuacagucagaggcgcaaagagaauggcgguacuaggcgacacagcaugggacuucggaucagugggaggcgcacugaacagccucggaaaggggauacaccaaaucuucggcgccgcauucaaaagccucuucggcggcaugagcugguuuucccagauacuaaucggaacgcuccuaauguggcuagggcuaaacaccaaaaacggcagcauaagccugaugugccucgcgcucggaggcguccucaucuuccuaucaaccgcagucucggcagauguaggcugcucagucgacuucagcaaa

SEQ ID NO: 2776 - RNA, 2100 nt, Artificial Sequence
  ZIKV prME variant CDS opt
ggggccgacacuuccguaggcaucgucggacuacuccugaccacggccauggccgccgaaguaacccgccgcggcagcgcauacuacauguaccucgaccgcaacgacgccggggaagcuauaucguucccaacaacccucggaaugaacaaaugcuacauacaaaucauggaccucggccacaugugcgacgcaaccaugagcuacgaauguccaaugcuggacgaagggguagaaccagacgacguggacugcuggugcaacaccacaagcaccugggucgucuacggaaccugccaccacaagaaaggagaggcccgacgaagucgccgcgcagucacccucccaagccacucuacacgaaaacuucaaacccggucacaaacauggcucgaaucaagagaauacaccaaacaccucauccgagucgaaaacuggaucuucagaaaccccggauucgcccucgcagcggccgccauagcguggcuacuaggcucaagcaccucacaaaaagucaucuaccuggucaugauccuccuaauagcacccgccuacagcauccgcugcaucggcgucucaaacagagacuucguagaaggaaugagcggaggaacauggguagacauagugcucgaacauggaggcugcguaaccgucauggcccaagacaaaccaaccgucgacauagaacuggucacuacaaccguaucuaacauggccgagguaagaucauacugcuacgaagccuccaucuccgacauggccagugacagccgaugcccaacgcaaggcgaagccuaucucgacaaacaauccgacacccaauaugucugcaagcgcacacucguagaccgcggcuggggaaacggcugcggccucuucggcaaaggcagccuaguaaccugcgcaaaauucgcaugcuccaagaaaaugacaggaaaauccauccaacccgaaaaccucgaauaccgcaucaugcucuccgugcacggcagccaacacuccggaaugaucguaaacgacaccggacacgaaacagacgaaaaccgcgccaaagucgaaauaacaccaaacuccccacgcgcggaagccacacuaggcggcuucggcucccuaggccucgacugcgaacccagaacaggacucgacuucagcgaccucuauuaccuaaccaugaacaacaaacauugguuaguacacaaggaaugguuucacgacaucccccuccccuggcacgcaggcgcagauacaggaacaccacacuggaacaacaaagaagcccucguagaauuuaaagacgcccacgcuaaacggcaaacaguaguaguccuaggcagccaagagggggccguacacaccgcacucgcaggcgcccucgaagcugaaauggauggcgccaaaggcaggcucucaucgggucaccucaaaugccgacuaaaaauggacaaacuacgucuaaaaggggucucuuacucacucuguacggcggccuucaccuucaccaaaauaccagcagagacacuacacggaaccgucacagucgagguccaauacgccggcacagacggaccaugcaaagucccugcacaaauggccgucgacaugcaaacccucacaccaguaggacgccucaucacggccaaccccgucaucacagaaagcaccgaaaacuccaaaaugaugcucgaacuagaucccccguucggagacagcuacaucguaauaggcgucggagagaagaaaauaacacaccacuggcaccgauccggauccacaauaggcaaagccuucgaagcaaccgucagaggcgcaaaacgaauggccguacugggagacacagccugggacuucggaagcgugggcggagcacucaacagccuuggcaaaggaauccaccaaaucuucggcgcagcauucaaaucacucuucggaggcauguccugguucucacaaauacugauagggacacuccugaugugguuaggucucaacaccaaaaacggcagcauuucucucaugugccucgcccucggaggaguacucaucuuccucuccacagcggucagcgcagacgucggaugcuccgucgacuuuucgaaa

SEQ ID NO: 2777 - RNA, 2097 nt, Artificial Sequence
  ZIKV prME variant CDS opt
gccgacaccagcgucggaaucgucgggcuccuauugaccaccgccauggccgccgaagucacccgccgcggaagcgccuacuacauguaccuagaccgaaacgacgcaggcgaagccaucagcuuccccacaacacuaggcaugaacaaaugcuacauucaaaucauggaccuaggccacaugugcgacgcaaccaugucauacgagugucccaugcuagacgaaggaguagaaccagacgauguagacugcuggugcaacaccaccuccacaugggucgucuacggaaccugccaccacaaaaagggcgaggcacgacgaucacgccgcgccgucacucuaccaucacacucaacucgaaaacuacaaacccgcucccaaacaugguuagaaagccgcgaguauacgaaacaccuaauccgaguagaaaauuggauauuccggaacccaggcuucgcacuggcagccgccgcaaucgcauggcuucugggauccucaacgucacaaaaagucaucuaccucgucaugauacugcucauagcaccagcauauuccauccgcuguaucgggguauccaacagggacuucguugaaggcaugucaggagggacaugggucgacaucguccucgaacacggaggcugcgucacagucauggcacaagacaaacccaccguagacaucgagcucgucaccacaacagucagcaacauggccgaaguccgcagcuacugcuacgaagcaucaaucagcgauauggccagcgacucaaggugcccuacucaaggcgaggcuuaccuagauaaacaaagcgacacccaauacgucugcaaacgcacccuaguagaccgaggauggggaaacggaugcggccucuucggcaaaggcucccucgugacaugcgcaaaauucgcaugcagcaagaaaaugacaggcaaaagcauacaaccagaaaaccucgaauacagaaucaugcugagcguccacgggucacaacacucaggcaugauagugaacgacaccggccacgaaaccgacgaaaaccgcgcaaaaguagaaauaaccccaaacagcccacgagccgaagccacccuaggcggcuuuggaagccucggccuagacugcgagccccgcaccggucuagacuucagcgaccucuacuaccugaccaugaacaacaaacauuggcucgugcacaaagagugguuccacgacauaccccuaccuuggcacgcaggagcagacaccggcacaccccacuggaacaacaaggaggcacugguagaguucaaggacgcccacgcaaaacgacaaacaguagucgugcuaggaucucaagaaggcgccguccacacagccuuagccggggcacucgaagcagagauggacggagccaaaggacgacuauccuccggccaucucaaaugccgccucaaaauggacaagcuccgacuaaaaggcguaagcuacagccuuugcacggcagcauucacguucacgaaaauucccgccgaaacacuccacggcacaguaaccgucgaaguacaauacgccggcacagaugggcccugcaagguccccgcccaaauggcaguugacaugcaaacccucacccccguaggccggcugaucaccgccaacccagucaucaccgaauccaccgagaacagcaaaaugaugcucgaacucgaucccccuuucggagacuccuacauagucaucggaguaggagaaaagaaaaucacccaccacuggcaccgcagcggcuccaccauaggaaaagcauucgaagcuaccguccgcggggccaaacgcauggccguacucggcgacacggcgugggacuucggcucgguuggaggagcccuaaauagccucggcaaaggaauccaccaaauauucggagcggcuuucaaaucccuuuucgguggcaugucaugguuuagccaaauucucaucggaacacugcucauguggcugggcuuaaacaccaaaaauggaucaaucucgcucaugugccuagcacuaggagggguccuaauauuccugucaaccgcagugagcgccgacguaggcugcagcgucgacuucucaaaa

SEQ ID NO: 2778 - RNA, 2094 nt, Artificial Sequence
  ZIKV prME variant CDS opt
gacacaucaguuggcaucgucgggcugcuacucaccacggccauggccgcagaagugacaagaagaggaagcgcauacuacauguaucuggaucgcaacgacgccggcgaagcgaucagcuucccaacgacccucggaaugaacaaaugcuacauacagaucauggaccuaggacacaugugcgacgcgaccauguccuacgagugcccaaugcuagacgaaggcgucgagccagacgacgucgacugcugguguaauacgaccucaaccuggguagucuacgguacaugccaccacaagaaaggcgaagcacgaagaucaagacgagccgucacccuacccucacacagcacuagaaaacuccaaacccgaagucaaacauggcuagaaagucgagaauacacgaaacaccugauccgcguagaaaacuggauauuccgaaacccaggcuucgcgcucgccgcagccgccauagccuggcuccucggcagcagcaccagucagaaggucauauaucucgugaugauccuccucaucgccccugccuacucaauaagaugcaucggcguaagcaaccgggacuucguggaaggaaugucuggaggcaccuggguagacauaguccucgaacacggaggcugcguaacuguaauggcccaagacaaaccuacagucgacauugaacuggucaccaccaccguauccaacauggccgaagugcgcagcuacugcuacgaagccagcaucucagacauggcgagugacagccgaugccccacucaaggcgaagccuaccuagacaaacaaagcgacacacaauacgucugcaaacgaacacucgucgaucguggaugggguaacggaugcggccucuucggcaaagguucccuagucacuugcgcaaaauucgccugcagcaaaaagaugacaggaaagagcauacaacccgaaaaccuagaauaccgcaucaugcugagcguccacggcagccagcacagcggaaugauaguaaacgacacaggacacgaaaccgacgaaaauagggcgaaagucgaaaucacccccaacagccccagagcggaagcaacacuagguggcuucgggagccucggauuagacugcgagccccgaacaggccucgacuucagcgaccuauacuaccuaacaaugaacaacaaacacugguuaguccacaaagagugguuccaugacaucccccucccauggcacgccggcgccgacaccggcacaccccacuggaacaacaaggaggccuuagucgaguucaaagacgcccacgcaaaacgacaaacagugguaguccuaggaagccaggaaggagccguccacacggcccucgcaggagcacucgaggccgaaauggacggcgcaaaaggccgccugagcucaggacaccucaaaugccgccuaaaaauggacaaacuaagacucaaaggaguaagcuacucccuuugcacagcagccuucacauucacgaagaucccagcagaaacacugcauggcacagugacaguagaaguacaauacgccggcaccgacggaccaugcaaagugcccgcccagauggccguagauaugcagacucuaacucccguaggcagacuaaucaccgcaaaccccgucaucaccgagagcacagaaaacagcaaaaugaugcuagagcucgaucccccauucggagacaguuacauaguaaucggaguaggcgagaagaaaaucacccaccacuggcaccgcaguggauccacuauaggcaaagccuuugaagcaacaguccgcggcgcaaaaaggauggcaguccuaggagacaccgcaugggauuucggcagcguaggcggagcacuaaacagccucggcaaaggcauacaccaaauauucggagccgccuucaagagccuauucggcggcauguccugguucagccaaauacuaaucggcacccuccucauguggcucggacugaacaccaaaaacgggucaaucagccucaugugccuggcacugggagggguacucauauuccuaagcaccgcaguaucagccgacguagguugcagcguagacuuuagcaaa

SEQ ID NO: 2779 - RNA, 2091 nt, Artificial Sequence
  ZIKV prME variant CDS opt
accucagucggcauaguaggacugcuccugacaacagcgauggccgccgagguaacucgaagaggaagcgcguacuacauguaccucgaccgaaacgacgcgggcgaagcaaucagcuucccgaccacccuaggcaugaacaaaugcuacauccaaauaauggaucugggacacaugugcgacgcaaccaugucauacgaaugucccaugcucgacgaaggaguagaacccgacgacguggauugcuggugcaacacaaccagcaccuggguagucuauggaacaugccaccacaagaaaggcgaagcccgacgauccagacgugccgucacgcuacccagccacagcacacgcaaacuccaaaccagaagccaaacauggcucgaaagccgagaauacaccaaacaccucauaagagucgaaaacuggauauuccgcaaccccggguucgcacuagcugcagcagccaucgcauggcuccuaggcuccagcacaagccaaaaagucauauaccuugucaugauccuacucauagcaccggccuacuccauacgcugcauaggcgucuccaaccgagacuucgucgaaggaaugagcggaggcaccuggguagauaucguccuggagcacggcggaugcguaaccgucauggcgcaagacaagccaaccguagacaucgagcucguaaccaccacgguuagcaacauggccgaaguccgcuccuacugcuacgaagcaagcauaagcgacauggcaagugacagcagaugccccacucaaggcgaagcguaccucgacaaacaaagcgacacacaauacguaugcaaacgaacccucguagacagaggcuggggcaacggcugcggccuauucggaaagggcucccucguaaccugcgcgaaguucgccugcucaaagaaaaugacaggcaaaucgauacaaccggaaaaccucgaauacagaauaaugcuguccguccacggaucacaacacagcggaaugauagugaaugacacaggacaugaaaccgacgagaaccgagcaaaagucgaaauaacaccaaacuccccacgggccgaagccacccucggagguuuuggcagcuuaggccucgacugcgagccacgaacgggccucgacuucucagaccucuacuaccuaacgaugaacaacaaacacuggcuuguccauaaagaaugguuccacgacauaccccuccccuggcacgccggagccgacaccggcacaccccacuggaacaacaaagaggcgcuaguagaguucaaagacgcccacgccaagagacaaaccgugguaguacuagggagccaagaaggcgcgguacacacagcacuagccggagcccucgaagccgaaauggauggagcaaaagggcgacucagcuccggccaccucaaaugccgccuaaaaauggacaaacuaagacugaagggcguaagcuacagccuaugcacagccgcauucaccuucaccaaaauacccgccgaaacccuacacggaacagucaccgucgaaguccaauacgccgguaccgacggaccgugcaagguaccggcacaaauggcaguagacaugcaaacucuaacccccguaggcagacucaucacggccaaccccguaauaaccgaaucuacagaaaacaguaagaugaugcucgaacucgacccacccuuuggcgacuccuacaucgucauaggagucggagaaaagaaaaucacccaccacuggcacaggaguggcagcacaaucgguaaagccuucgaagccacaguacgcggggcaaaacgcauggcgguccucggcgacacagcaugggacuucgggagcguaggcggcgcgcuaaacagccucggcaaaggcauccaccagaucuucggcgcggcauucaaaucacuauuuggagggaugagcugguucucucaaauccucauaggaaccuugcugauguggcugggccuaaacacgaaaaacgggagcaucagccucaugugccuugcccuagguggcguccuaaucuuccuuagcacagccgucucagccgacgucggaugcagcguggacuucaguaaa

SEQ ID NO: 2780 - RNA, 2091 nt, Artificial Sequence
  ZIKV prME variant CDS opt
accagcgucgguauaguaggccuacuacuaacaacggccauggcagccgccgugacacgcagaggaucugccuacuacauguaccuagaccgcaacgacgccggcgaagcgaucuccuucccuacuacccugggcaugaacaaaugcuacauccaaaucauggaccuaggacacaugugcgaugccacaaugucauacgaaugcccuaugcuggacgagggagucgaacccgacgacguagauuguuggugcaacaccacaagcacauggguaguauauggaacaugccaccacaaaaagggcgaagcgcgcagaagccgccgcgccgucacccuacccagccacuccacaagaaaacugcaaacgagaagccaaaccuggcucgaaucccgcgaauacaccaaacaccucauccgcgucgaaaacuggaucuuccgaaaccccggcuucgcgcuagccgcggccgcuaucgcguggcuccugggaucaaguaccagccaaaaaguaaucuaccuaguaaugauccuccucaucgcaccagccuacuccauccgaugcauuggcguaagcaacagagacuucgucgagggcaugaguggcggcaccuggguagacaucgugcuagaacacggaggcugcgucaccguaauggcccaagacaaacccacagucgacauagaacucguaacaacaacgguuucaaacauggcagaggugagaucguauugcuacgaagccagcaucagcgauauggccagcgacagccgcugcccgacacaaggagaagcguaccuggacaaacaaagcgacacccaauacgucugcaagcgaacacucguagaccgcggguggggcaacggcugcggacuauucggaaaaggaagccuuguaaccugcgcaaaguucgccugcagcaagaaaaugacaggcaaaagcauccaaccagaaaaccucgaauaccggaucaugcucagcguccauggcucacaacacagcggcaugauagucaacgacacgggccacgaaacagacgaaaaccgagcaaaaguagaaauaacccccaacuccccaagagcggaagccacccuaggcggauucggaucccucggacucgacugcgaaccacgaaccggacucgacuucucagaccucuacuaccucaccaugaacaacaaacacuggcucguccacaaagaaugguuccacgacauaccacucccauggcacgccggcgccgacacaggcacaccacacuggaacaacaaagaggcccuugucgaguucaaagacgcacacgcaaaacgccaaaccgucguaguccucggaucccaagaaggagcgguccacaccgcccucgcaggcgcccuagaagccgaaauggacggagcgaaaggacgccuaucaucggggcaccucaagugcagacucaaaauggacaaacuccgacuaaaaggcgucagcuacucacucugcaccgccgcauucacguucaccaaaauccccgccgaaacccuacacggaacagugacaguagaagugcaguacgcaggaacagacggaccaugcaaaguccccgcccagauggcaguagacaugcaaacacucacaccagugggacgccuaaucaccgccaaccccguaaucacagaaagcaccgaaaacagcaaaaugaugcuagaacucgacccacccuucggggacuccuacaucguaauaggagucggggaaaagaaaaucacgcaccacuggcaccgaagcgguuccacaaucggcaaagccuucgaagcaacaguacgcggcgcaaaacggauggcgguccucggagacaccgcaugggacuucggaagcgucggaggcgcccuaaacagucuaggcaaaggaauacaccaaauauucggugcggccuucaaaagucuauucggcggcaugagcugguucagccaaauccucauaggaacacucuuaauguggcucggccuaaauacuaaaaacggcucaauuagccuaaugugcuuagcacuaggaggcgugcucaucuuccugucaaccgccgucuccgccgacguaggcugcagcguagacuuuagcaaa

SEQ ID NO: 2781 - RNA, 2103 nt, Artificial Sequence
  ZIKV prME variant CDS opt
cgaggcgcagacacgagcguaggcaucgucggccugcuuuuaaccacagcaauggcugcagccguaacccgacgaggaagcgcauauuacauguaccuagacagaaaugacgcaggagaagcaauaucguuccccacaacacuaggaaugaauaagugcuacauccaaaucauggaccucggacacaugugcgacgccacgaugucguacgaaugccccaugcuagacgaaggagucgaaccagacgacguggauugcugguguaacacaaccucaaccugggugguauacggcacgugccaccacaagaaaggcgaagcaagacgaucaagacgagcaguaacucuccccucccacagcaccagaaaacuccagacaagaucccaaacauggcuagaaucacgagaauacacaaaacaccugauaagagucgaaaacuggauauucagaaaccccggauucgcacucgccgcagcagccauagcauggcucuuaggcagcucaacaagccaaaaaguaaucuaccuagucaugauccuacuaaucgcgcccgcguacucgauccgcugcaucggcguaucgaacagagacuucgucgaaggcauguccggagggacgugggucgacauagugcuagaacacggcggaugcgucacagucauggcacaagacaaaccgacggucgacauagagcuaguaaccaccacaguaagcaacauggcagaagucagaaguuacugcuacgaagcauccauaucagauauggcaucagacuccagaugcccgacccagggagaggccuaccuagacaaacaaucagauacccaauacgucugcaaacgaacccugguagaccgcggcuggggaaacggcugcggccuguucggcaaggggagcuuaguaaccugcgcaaaauucgcaugcagcaagaaaaugaccggaaaaagcauccaacccgaaaaccucgaauaucgcauaaugcucagcguccacggcagccaacacagcggaaugauagucaacgacacaggccacgaaacagacgaaaacagggcaaaagucgaaaucacaccaaauagcccaagggccgaagcaacacucgggggcuucgggucacuuggccuagacugcgaacccagaacgggacuagacuucagcgaccuguacuaccucaccaugaacaacaaacacuggcuaguacacaaagaaugguuccacgacauaccccucccauggcacgcaggagccgacaccgggacgccacacuggaacaacaaggaagcacucgucgaguucaaagacgcccacgcaaagcgccaaacaguagucguacugggcucccaagaaggggcaguacacacggcacucgcaggcgcacucgaagcagaaauggacggcgccaaaggccgccucucaagcggacaccucaaaugccgccucaagauggacaagcuccgacucaaaggcguaagcuacagccuuugcacagcagcauucacauucacaaaaauacccgcagaaacacuccacggcacagucacagucgaagugcaauacgcaggaaccgacggcccaugcaagguaccagcacaaauggcagucgacaugcaaacgcuaaccccagucggccgccucauaaccgcaaacccaguaauaacugagagcacagaaaacagcaagaugaugcucgagcucgacccacccuucggcgauagcuacauagugauaggagucggcgagaaaaagaucacgcaccauuggcacagaagcggaagcacaauaggaaaagcguucgaagcaacagucagaggcgcaaaacgcauggccguccucggcgacacagcaugggacuucggcucaguaggaggggcacucaauagccuaggcaaaggaauacaccagauauucggagcggcauucaaaagccuguucggcgguaugagcugguucagccagauacuaauuggaacccuacuaauguggcuaggccuaaacaccaaaaacggaagcaucagccuaaugugccuagcacuuggcggaguacucauauuccucagcacagcagucuccgccgacguaggaugcagcgucgacuucagcaaa

SEQ ID NO: 2782 - RNA, 2127 nt, Artificial Sequence
  ZIKV prME variant CDS opt
cgagggcucucaucacgcaaacgccgcagucacgacguccuaaccguccaauuucuaauccuaggaaugcuccuaaugaccggaggggucacccgcagaggcucggccuacuacauguaccucgacaggaacgacgccggcgaagcaauuagcuuccccacaacccuugguaugaacaaaugcuacauacaaauaauggaccuaggacauaugugcgacgcaacgauguccuacgagugucccauguuggacgaaggcguagaaccagacgacguggacugcuggugcaacaccacaagcacauggguuguauacggcacaugccaccacaagaaaggagaagcccgccgaucacgacgugccgucacccugcccagccacagcacgcgcaaacuacaaacucgcucgcaaaccuggcuggaaagccgcgaauacacaaaacaccucauccgagucgagaacuggauauuccgcaaccccggcuucgcacucgcggcagccgcaauagcauggcuucuagggucaagcaccagccaaaaagucaucuaccucguaaugauccuccugaucgcccccgccuacuccaucagaugcaucggaguaucaaacagagauuucguagaaggcaugucagguggaaccuggguagacaucguacuagagcacggaggcugcgucaccgucauggcacaggauaaacccacagucgacaucgaacuggucacgaccacugucucaaacauggccgaagugcguagcuacuguuacgaagccagcaucagcgacauggcgagcgacagucgaugccccacccaaggggaagcauaccucgacaaacaaagcgacacacaauacguaugcaagcgaacacucguagaccgcggcugggggaacggaugcggacucuucggaaaaggcagccuagugaccugcgccaaauucgcuuguucaaagaaaaugaccggcaaaagcauacaaccggaaaaccucgaauacagaauaaugcucuccgugcacggaucucagcacagcggcaugauagucaacgacaccggccacgagaccgacgaaaacagggcgaaagucgaaauaacaccgaacagcccccgagccgaggcgacacucggcggcuucgggucccucggccuagauugcgaaccccgcacaggccucgacuucagcgaccucuauuaucuaacaaugaacaacaaacacuggcuaguccacaaagaaugguuccacgacauuccacuccccuggcacgcgggagcggacacgggaacaccacacuggaacaacaaagaagcacucguagaguucaaagacgcacacgccaaacgacaaaccguaguaguacuaggaagccaagaaggcgccgugcacacagcacuagcaggggcccuagaagccgaaauggacggcgccaaaggccgacuaagcaguggacaccuaaaaugccgccuaaaaauggacaaacuacgccuaaaaggagucagcuauagccuaugcacagccgcauucacguucacaaaaauucccgcggaaacgcuacacggaacuguaaccgucgaaguacaauacgccggcaccgacggaccgugcaaggucccugcacaaauggcuguagacaugcaaacacucacaccggucggccgucuaauaacagccaaccccguaaucaccgaauccaccgaaaacucaaaaaugaugcuggaacucgacccacccuucggagacaguuacauagucaucggagucggagagaaaaagaucacucaccacuggcacagaucaggcucaacgaucggaaaagccuucgaagcaacaguccgcggggcaaaaagaauggccguccuaggagacacagccugggauuucgguagcguaggaggagcccucaacucccuaggaaagggcauacaccaaauauucggagccgccuucaaaagccucuucggaggcaugucgugguucucgcaaauacuaaucggcacccuccugauguggcuagggcuaaacaccaaaaacggaucgaucucucucaugugccuagcccucgguggcgugcuaauauuccucuccaccgccgucagcgcggauguaggaugcagcguagacuucagcaag

SEQ ID NO: 2783 - RNA, 2127 nt, Artificial Sequence
  ZIKV prME variant CDS opt
cgcggacucagcucccgcaaacgacgcucacacgacguacuaaccgugcaauuccucauccuugggaugcuacucaugacaggcgcggugacccgacgcggcagcgcauacuacauguaccucgaccgaaacgacgcgggcgaagcaaucagcuuccccacaacacucggcaugaacaaaugcuacauacaaauaauggaccucggacacaugugcgacgccaccaugucguacgagugcccaaugcuagacgaaggcguagaacccgacgacgucgacugcuggugcaauaccaccucaacauggguagucuacggcacaugccaccacaagaaaggagaagcccgccgcucuagacgcgccgucacucuccccagucacucaacccgaaaacuccaaacgcgcucccaaacauggcucgagucccgcgaauacacaaaacaccucauccgaguagaaaacuggaucuuccgaaaccccggauucgcacucgccgcagcagccauagcauggcuccugggaucaagcacaucccagaaaguaaucuaccucgucaugauccuacuaaucgcucccgcguacagcauacgaugcauaggcgucagcaacagagacuucguagaaggaaugucgggcggcacauggguagacaucgugcucgagcacggcggaugcguaaccguaauggcccaagacaaacccacaguagacaucgagcucguaacuaccacagucaguaacauggccgaaguccgcagcuacuguuacgaggccucaauuucagacauggccuccgacagucgcugcccaacacaaggcgaagcguaccuggacaaacaauccgacacccaauacguaugcaaacgcacccucguugacaggggguggggaaauggaugcggauuauucgguaaagggucccuaguaaccugcgccaaauucgcaugcucaaagaaaaugaccggcaaaucaauacaaccagagaaccuagaauaccgcauaaugcucagcguccacgggagccaacauuccggaaugaucguaaacgacaccggacacgaaaccgaugagaaucgcgcaaaaguagaaaucacaccaaacuccccacgggcugaggcgacacuaggcggcuucggcagccuaggccuagacugcgaaccccgcaccgggcucgacuucucggaccuguacuaccucacgaugaacaacaaacacuggcucguacacaaagaaugguuccacgauaucccccucccauggcacgccggcgccgacaccggaacaccccacuggaacaacaaagaagcccucguagaguucaaagacgcccacgccaaaagacaaacagugguuguacuagggucacaggaaggcgccguacacacagcacucgccggagcccucgaagccgaaauggacggggcaaaagguagacuaaguagcggccaccucaagugccgacucaaaauggacaagcugcgacugaaaggggucaguuacucccuaugcaccgcugcauucaccuucaccaagaucccggccgaaacccuacacggaacagucaccgucgaagugcaguacgccggcacagacggccccugcaaaguacccgcgcaaauggccgucgacaugcaaacacucacgcccgucggacggcucaucacagccaaccccguaaucacggaaagcacagagaacagcaaaaugaugcuagaacuagacccacccuucggagacuccuacauaguaaucggcguaggcgagaagaaaauuacacaccacuggcacagguccggcucaacgauugguaaagccuucgaagcaacaguccgcggugccaagcgcauggcaguccuaggcgacacagcaugggacuucggcucagucggcggcgcacucaacagucugggaaagggcauacaucagauauucggcgcagccuucaagucgcuauucggagggaugagcugguucagccagauccucaucggaacacugcucauguggcuaggacuaaacaccaaaaacgguagcaucagccucaugugccuagcacuaggcggaguccuaauauuccuuagcacggcagucagcgccgacgugggcugcagugucgacuucucuaaa

SEQ ID NO: 2784 - RNA, 2118 nt, Artificial Sequence
  ZIKV prME variant CDS opt
cgcaucaucaacgcgcgcaaagaaaagaaacgacgcggagccgacaccucggucggaauagucggccuccuacugacaaccgccauggcagccgaggucacccgacgaggcuccgccuacuacauguaccucgaccgcaacgacgccggagaggccauuuccuuccccaccacccucggcaugaacaaaugcuacauccaaauuauggaccuaggacacaugugcgacgcaacaaugagcuacgaaugcccaaugcuagacgaagguguagaacccgacgacguagacugcuggugcaacacaacauccacaugggucguguacgguacaugccaucacaagaaaggcgaagcacgccgcagccgacgcgccguaacccucccaucccacagcacaaggaaacuucaaacacgcagccagacguggcucgaaagcagagaauacacaaaacaccucauacgaguagaaaacuggauauuucgcaacccgggcuuugcccucgccgccgcggccauagcauggcuauuaggcagcaguacgucccaaaaaguaauuuaccuagucaugauacuacuaauagcaccagccuacuccauaaggugcaucggagugucaaaccgcgacuucgucgaaggaaugagcggaggaacaugggucgacaucguccucgaacacggcgguugcgucacagucauggcccaagacaaacccacaguagacaucgaacucgucacgacaacaguauccaauauggccgaaguacgauccuacugcuacgaggcaagcauaucagacauggccuccgacucaagaugcccaacccaaggagaagccuaccucgacaaacaguccgacacucaauacgugugcaaacggacacuugucgaccgcggguggggcaacggauguggccuauucggcaaaggcagucugguaaccugcgcaaaauuugcaugcuccaagaaaaugacagggaaauccauacaacccgaaaaccucgaauacagaaucaugcucucaguccacgggucacagcacagcggcaugauaguaaacgacaccggccacgagacagacgaaaaccgcgccaaaguagaaauaaccccaaacagcccccgggccgaggccacccugggcggguucggcagccucggucucgacugcgaaccccgaacaggucuagauuucucagaccuauacuaccuaaccaugaacaacaaacauuggcucguacauaaagagugguuccacgacaucccacucccauggcacgcaggcgcggacaccgguaccccacacuggaacaacaaagaagcgcuagucgaguucaaagacgcacacgcaaaaagacaaacagucguaguccuaggcucccaggaaggagccguccacacggcacucgccggagcacucgaggcagagauggacggcgccaaaggccgccucagcucaggacaccuaaaaugccgccucaaaauggacaaacucagacucaaagggguaucauacagccuaugcacagccgcauuuacguucaccaaaauaccagccgagacacuccacggcaccguaacagucgagguccaauacgcaggaacagacggccccugcaaagucccagcccaaauggccgucgacaugcaaacacucacacccgugggccgucuaauaaccgcaaaccccguuauaacagaauccacagaaaacuccaaaaugaugcuggaacucgaucccccauucggggacagcuacaucguaaucggcguaggcgaaaagaaaaucacccaccacuggcaccgcuccggaagcacaauaggcaaagcauucgaagcaaccguccgcggagcgaaaagaauggcuguacucggagacaccgcgugggacuucggcagcgugggcggcgcacucaacucccuaggaaaaggcauccaccagauauucggcgcagccuucaaaucccuuuucggcggcauguccugguucucccaaauccuuauaggaacccuucuaauguggcucggccucaacaccaaaaacggcuccauaucccucaugugccucgcccucggcggcguacuaaucuuccuaagcacagccgucagcgccgacgucggaugc

SEQ ID NO: 2785 - RNA, 2115 nt, Artificial Sequence
  ZIKV prME variant CDS opt
aucaucaacgcccgaaaagaaaagaaacgacgaggcgccgacacaagcguaggcaucguaggacuccugcucacuacagccauggcagcagaagugacccgccgcggauccgccuacuacauguaccucgaccgcaacgacgccggagaggcaauaucauuccccaccacgcuaggaaugaacaaaugcuacauacaaauaauggaucucggacacaugugcgacgccaccaugagcuacgaauguccaaugcuagacgagggaguugaacccgaugacguagacugcuggugcaacaccacaucgaccugggucgucuacgguaccugccaccacaagaaaggcgaagcccgacgcucacgccgagccgucacucuacccagccacuccacaagaaaacuccaaacacgcagccaaacauggcuagaaucccgcgaauacacaaaacaccuaauacgaguagagaacuggaucuucagaaaccccggcuucgcgcucgcagcggccgccaucgcauggcucuuaggcuccagcaccagccagaaaguuaucuaccucguaaugauccuccucaucgccccagccuacuccauccgaugcauuggaguaagcaacagggacuucguagaaggaaugagcggcggaacaugggucgacauaguacucgaacacggaggcugcguaaccguaauggcacaagacaaacccaccguggacauagaacucgucacaaccaccguuuccaacauggccgaagugagaagcuacuguuacgaagccagcaucucagacauggcuuccgauagcagaugccccacccaaggagaggcauaccucgauaaacaaucagacacccaauacgucugcaaaagaacacucguagaccgcgguuggggcaacggcugcggacucuuuggcaaaggaucccuaguuaccugcgcaaaauucgccugcagcaaaaagaugacgggcaagucaauacagcccgaaaaucuggaauaccggaucaugcuaucgguccacggcagccaacacagcggcaugaucgugaacgacaccggccacgaaaccgacgaaaacagagcaaaagucgagauaaccccaaacucaccccgagcagaagccacccuaggcggauucggcagccugggccuagacugcgaacccagaaccggccuagacuucuccgaccuguacuaccucacaaugaacaacaaacauugguuaguacacaaagaaugguuccacgacauaccucuaccauggcacgccggcgcagacaccgggaccccgcacuggaacaacaaggaagcacugguagaguucaaggacgcacacgcaaaacgccaaacggucgucgugcucggcagccaagaaggagccguccacaccgcgcuagcaggagcucucgaggcggaaauggacggcgccaaaggcaggcucuccucagggcaccucaaaugccgccucaaaauggacaaacuccgacucaaagguguguccuacucucucugcacagcagccuucacauucaccaagaucccugccgaaacacuccacgggacagucacgguagaaguccaauacgccgguacagacggaccgugcaaagucccagcccaaauggccguagacaugcagacacuuaccccagucggccgccucaucaccgccaaccccgucaucacagaaagcaccgaaaacucaaaaaugaugcuggaacucgacccacccuucggugacagcuacaucguaaucggaguaggagagaagaaaauaacacaccacuggcaucgcagcggcuccaccaucggcaaagcauucgaggcuacaguaagaggagccaaacgaauggccguccuaggagacaccgcaugggacuucgggagcgucggcggcgcacuaaacagccucggaaaagggauacaucaaaucuucggcgccgccuuuaaaucauuauucggcggcaugagcugguucagccaaauauuaaucggaacgcuacucauguggcuagggcucaacaccaaaaacggauccaucucacuaaugugccuggcucucggaggcguccucaucuuccuuucaacagcaguaagcgccgacguaggcugc

SEQ ID NO: 2786 - RNA, 2112 nt, Artificial Sequence
  ZIKV prME variant CDS opt
aucaacgcccgcaaagagaagaaacgcagaggcgccgacacgagcguaggaaucgucggccuacuacucacuacagccauggcggccgaggucacacgcagagggucagccuacuacauguaucucgacaggaacgacgccggagaagcgaucucauuccccaccacccucggaaugaacaaaugcuacauccaaauaauggaccucgggcacaugugcgacgcuacaauguccuaugagugcccuaugcuagacgaaggcguggaaccugacgacguagauugcuggugcaacacaacuucaaccuggguaguauacggcacaugccaccacaagaaaggagaggcacgcaggagccggcgcgccgucacgcucccaucacacuccacgcgaaaacuucaaacccggagccaaacuuggcuagaaagcagagaauacaccaaacaccucauaagaguagaaaacuggaucuuccgaaaccccggauucgcgcucgcagccgcagccaucgccuggcuacucggcucgagcacaagccaaaaagugaucuaccuaguaaugauacuccuaaucgcccccgccuacucaauccgaugcaucggaguaucaaaccgagacuucguagaaggaaugucaggaggaacuugggucgauauaguacuagaacacggaggcugcgucacggucauggcccaagacaaaccaacuguugacaucgaauuaguaaccacgaccgucagcaauauggcagaggugcgauccuacugcuacgaagccuccaucucggacauggcaagcgacucacgaugcccaacccagggagaggcguaccucgacaaacaaagcgacacacaguacguaugcaaaaggacgcuagucgaccgcggaugggggaacggaugcgggcucuuuggaaaaggcucgcucguaacaugcgccaaauucgcgugcaguaaaaagaugacaggcaagagcauacaaccagaaaaccuagaauaccggaucaugcucuccguccacggcucccaacacagcggaaugauagucaacgacaccggacacgaaaccgacgagaacagagcaaaagucgaaauaacacccaacagcccccgcgccgaagcaacccuaggaggguucgggagccucggccuggacugcgaaccacgcaccggacuagacuucagcgaccuauacuaccuaacaaugaacaauaaacacuggcuaguccacaaagagugguuucacgacauaccccugccauggcacgcaggagcugacaccggaaccccacacuggaacaacaaagaagcccuggucgaguucaaggacgcccacgccaaaagacaaacaguagucguacucggcucacaagaaggcgcgguacacacagcacucgccggcgcgcucgaagccgagauggacggcgccaagggcagauuaagcagcggccaccucaagugcaggcuaaaaauggacaaacuacgacugaagggcguaucauacucacucugcacagcugcauucacauucaccaagauaccagcggaaacacuacacgggacaguaaccguagaaguacaauacgccggcaccgacggccccuguaaggucccggcccaaauggcagucgacaugcagacccuaaccccugucggaagacugaucaccgccaacccaguaaucacagaaucaacagagaacucaaaaaugaugcuggaacuggacccgcccuucggagauagcuacaucgugaucggcgucggugaaaagaaaaucacgcaccacuggcacagaagcgggagcaccauagguaaagccuucgaggcgacaguuaggggcgccaaacgaauggcaguccucggcgacacagcaugggacuucggcagcgugggcggagcacucaacucacuagggaaaggaauccaccaaauauucggcgcagcauuuaaaagccuauucggaggaaugagcugguucucacagauccuaauuggcacacuacuaauguggcuagggcucaacaccaaaaacggaagcaucagccuuaugugccucgcacucgguggaguccuaauuuuucugagcaccgccgucagugcagacgugggaugc

SEQ ID NO: 2787 - RNA, 2109 nt, Artificial Sequence
  ZIKV prME variant CDS opt
aacgcacgcaaagaaaagaagcgccgcggagccgacacauccguaggaaucguaggacuacuccucacaacggccauggcagccgaaguaaccagacgcggcuccgccuacuacauguaccucgaccgaaacgacgcaggagaggcuaucucauuccccacaacccucggaaugaacaaaugcuauauacagauaauggaccugggccacaugugcgacgcaacaaugagcuacgaaugcccaauguuagaugaaggcguagaacccgacgacgucgacugcugguguaacaccacaucaaccuggguaguauacggcacaugccaccacaagaaaggcgaagcgcgcagaagccgucgagcagucacacuaccaucacacucaacacgaaaacuucagacccgaucacaaaccuggcuagaaucacgagaauauacgaaacaccucauccgaguagaaaacuggaucuucagaaaccccggcuucgcccuugcagcggcggccaucgccuggcuccuagggaguucaaccagccagaagguaaucuaccucgucaugauccuccucaucgcaccagccuacagcauccgaugcaucggcgucagcaacagagacuucguagaaggaaugagcggaggcacauggguagacauaguacucgaacacggcgggugcguaaccgugauggcacaagauaaacccacagucgacaucgaacuugugaccaccaccguaagcaacauggcagaaguaagguccuauugcuacgaagcaucaauuucugacauggcauccgacagccgaugcccaacgcagggagaagccuaccuagacaaacaaagcgacacccaauacguaugcaaacgaacgcugguagaccgcggcuggggcaacgguugcggacuauucgggaaaggaagccuagucacaugcgccaaauucgccugcagcaaaaagaugacaggcaaaucaauccaacccgaaaacuuggaauacagaaucaugcuauccguccacggaagccaacacuccggcaugauagucaacgacacgggacacgaaacagacgaaaaccgugcaaaaguagaaaucaccccgaauagcccaagagcggaagccacacuagggggcuuuggcagccucggccuagauugcgaaccacgaacagggcuagauuucucggaccuauacuauuuaaccaugaacaacaaacacuggcuaguucacaaagaaugguuccacgacauaccgcucccguggcacgccggcgcagauacgggcaccccacacuggaacaacaaggaagcgcugguagaguucaaagaugcucacgccaaacgccaaaccgucguaguacuaggcucacaggaaggugcaguacacaccgcacuagccggagcacucgaagccgaaauggacggagcaaaaggacgacucagcagcggacaucuaaaaugucgacucaaaauggacaaacucaggcucaagggagucagcuacagccuaugcacggccgcauucacauucaccaaaauaccggcagaaacacuccacgguaccguaacaguagagguccaauacgccggcaccgacggccccugcaaaguaccagcacaaauggcaguagacaugcaaacccucacccccguaggacgacuaauaacggccaacccaguaauaacugaaagcaccgaaaacaguaagaugaugcuagaacuggacccaccauucggugacucauacaucgucaucggcguaggcgaaaagaaaauaacccaccacuggcaccgaagcgggucaaccauaggaaaagccuucgaagcgacagugcgcggagccaaacgcauggccguacugggcgacacagcaugggacuucggaucaguaggcggcgcccucaacagccucggcaaagggauccaccaaaucuucggagccgcguuuaaaucgcuauucggcggcauguccugguucucccaaauccucaucggcacccuacucauguggcuuggccuaaacaccaaaaauggcucaaucagccucaugugccuagcacucggaggcguccugaucuuccugucaacagcggucucggcagacgucggcugu

SEQ ID NO: 2788 - RNA, 2106 nt, Artificial Sequence
  ZIKV prME variant CDS opt
gcacgcaaggaaaagaagcgccgcggagcagacaccucagucggaauagucggccugcuacucaccaccgccauggcggcggaaguaacccgccgggggucagccuauuacauguaccucgaccgcaacgacgcaggcgaagccaucucauuccccaccacgcuaggcaugaacaaaugcuacauccaaauaauggaccucggccacaugugcgacgccaccaugagcuacgaaugcccaaugcuagacgaaggcguagaacccgacgacgucgauugcuggugcaacacaacaucaacauggguugucuacggaaccugccaccauaagaaaggcgaagcacgacgcagccgcagagcaguuacacuacccucccacucgacaagaaaauuacaaacacgaucacaaaccuggcucgaaucacgagaauacaccaaacaccuaauccgcgucgaaaacuggauauuccgaaaucccggauucgcucuagcagcagccgcgaucgccuggcugcucggcuccuccacaucccaaaaagucauuuaccucgucaugauccuauuaaucgcaccggccuacucaauacgcugcauaggaguauccaacagagacuucgucgaagggaugucaggcggcaccuggguagacaucguacuagaacacggcggcugugucaccguaauggcccaagacaaaccaaccgucgacaucgaacucgucacgaccaccguaagcaacauggccgaaguacgcuccuauugcuacgaagcaagcauaucagauauggcaagcgacucccgcugcccaacacagggcgaagcauaccuggacaaacaaagugacacccaauacgucuguaagcggacccucgucgaccgcggauggggcaacggcugcggccucuucggaaaaggaucccuaguaacaugcgccaaauucgcaugcuccaagaaaaugaccggcaaguccauacaaccagaaaaccuagaauaccggaucaugcuaaguguacacggcagccaacauuccggaaugauagucaacgacacagggcacgaaaccgacgaaaaccgagcaaaaguagaaauaaccccaaacucccccagagcagaagccacacuaggcggcuuuggcucucuaggccucgacugcgaaccaagaacaggucuagacuucucagaccuuuacuaccuaacaaugaacaacaaacacuggcucguacacaaagaaugguuccacgacaucccauugccauggcacgcaggagcagacacaggaacaccccacuggaacaacaaagaagcgcuagucgaguucaaagacgcacacgccaagagacaaaccguaguaguccucggcucacaagaaggugccguccacaccgcacuagcaggcgcacuagaagccgaaauggacggagcaaaaggacgacuauccucaggacaccuaaaaugccgucucaaaauggauaaacuaagacugaaaggcguaucauacucacucugcacagcagccuucacguucaccaaaauccccgccgaaacacuacacggcacagucacaguagaaguacaauacgccggcaccgacggucccugcaagguaccagcucaaauggcggucgacaugcaaacccuaacccccguagguagacucaucacugcaaaccccgugaucaccgaaucaaccgaaaacucaaaaaugaugcuggaacuagacccaccguucggcgacagcuacauagucaucggaguaggggagaaaaagauaacccaccacuggcacagaaguggaucgaccaucggcaaagccuucgaagcaacaguucgaggcgccaaaagaauggcaguccucggagacaccgcgugggacuucggcuccguaggcggagcccucaacucccucggcaagggaauacaucagaucuucggcgccgccuucaagagccuuuucggaggaaugagcugguucucacaaauccuaauaggcacacuacucauguggcucggccucaacaccaaaaacggguccaucucccuuaugugccuggcacugggcggaguacucauuuuccucagcacugccgucagcgccgacgucggcugu

SEQ ID NO: 2789 - RNA, 2103 nt, Artificial Sequence
  ZIKV prME variant CDS opt
agaaaagaaaaaaaacgccgaggagcagacacaagcgucggcaucguaggauuacuacugacaaccgcgauggcagccgaagucacaagacgaggcucagcauacuacauguaccucgaccgcaacgacgcaggugaagcaauaagcuucccgacgacucuaggaaugaacaaaugcuauauucaaauaauggaccuaggacacaugugcgacgcaaccaugagcuacgaaugccccaugcuagacgagggugucgaacccgacgacguagacugcuggugcaacaccacaagcaccugggucgucuacggcacaugccaccacaaaaaaggagaggcacgcagaagcagaagagcagucacgcuccccucccacagcacaagaaaacuacaaaccagaucccaaaccuggcuggagucgagagaauacacaaaacaccucauaaggguagaaaacuggaucuucagaaacccgggauucgcccuagcggcagccgccaucgcauggcuccugggcucaaguacuagccagaaagugauauaccuaguaaugauacugcuaauagcacccgccuacucaauccgcugcaucggcgucucaaaccgagacuucgucgaagguaugagcggcgguacauggguagacaucguacuagaacauggcggaugcgucaccgucauggcacaggacaaacccacaguggacaucgaacuggucaccacaaccgucucuaacauggcagagguacgcuccuacugcuacgaagccucaaucucagacauggcgagcgacucccgcugucccacccagggcgaagccuaccuggacaaacaauccgauacacaauacgugugcaaacgcacacucguugaccgagggugggggaacgguugcggccucuucggcaaaggcagccuggugaccugcgcaaaauucgcgugcucgaaaaaaaugacaggcaagagcauacaaccagaaaaccuagaguaccggaucaugcuaucaguccacggaucgcaacacucaggaaugauagucaacgauacaggacaugaaaccgacgaaaaccgagcgaaaguagaaaucacacccaacagcccgcgcgccgaagcaacacuagggggcuucggaagccucggacuagacugcgaaccacgcaccggccuagacuucagcgaccuuuacuaccuaaccaugaacaacaaacacuggcuaguccacaaagaaugguuccaugacaucccgcuaccguggcacgcuggcgcagacacggggaccccacauuggaacaauaaagaagcacuagucgaauucaaagacgcgcacgcaaaacggcaaacagucgucguacuaggcagccaagagggagcuguccauaccgcgcuagccggagcccuagaagcagaaauggacggagcaaaaggccgccuuagcuccggccaccucaaaugucggcuuaagauggacaaacucagacucaagggcgucagcuacagccucugcaccgcagccuucacauucaccaaaaucccggccgaaacccuacacggaacaguaacaguagaggugcaauacgcgggaacagacgguccaugcaaagucccagcccaaauggcuguagacaugcaaacccuuaccccgguagggagacuaauaacagccaaccccguaauuacugaaucaacagaaaacagcaaaaugaugcucgaacucgacccacccuucggcgauagcuacauaguaaucggggucggagaaaaaaaaauaacacaccacuggcacagaucaggauccacaauaggaaaagcauucgaagccaccguuaggggagcaaaacgaauggcaguacucggcgacaccgccugggacuucggcagcguaggcggcgcccuaaacagccucggaaaaggaauccaccaaauauucggugcagcauucaaaagccucuucggcggcaugagcugguucagccaaauacucaucggcacgcuccuaauguggcuaggacuaaauacaaaaaacggcaguaucagccuaaugugccucgcgcuagggggcguccuaaucuuccucucaacagcagucagcgccgacgucggaugc

SEQ ID NO: 2790 - RNA, 2100 nt, Artificial Sequence
  ZIKV prME variant CDS opt
aaggaaaaaaaacgacgcggagcagacacaucagucggaaucguaggccuccuccugacaacagcaauggcugccgaaguaacgaggcggggaagcgcguacuacauguaccucgacagaaacgacgcaggcgaagccaucuccuucccaaccacauuaggaaugaauaaaugcuacauccaaauaauggaccucggacacaugugcgacgccacaaugucauacgaaugcccgaugcucgaugaaggcgucgaacccgaugacguagacugcuggugcaacacaacgagcacaugggucgucuacggaacaugccaccacaaaaaaggcgaggcccgacgaucacgccgagcagugacacuccccucccacagcacccgcaaauuacaaacgagaagccaaacauggcucgaaagccgcgaauauaccaaacaccugaucagaguggaaaacuggauauucaggaaccccggcuucgcccuggcagcagcagcaauagccuggcuacuuggcaguagcacaucccagaaagucaucuaccucgucaugauacuccucaucgcaccugcauacagcauccgaugcaucggcguguccaacagagacuucguagaaggcaugagcggcggaacaugggucgacauaguacucgaacacggcggcugcguaaccgugauggcucaagacaaacccacagucgacaucgagcuagucaccacgaccguaagcaacauggcagaaguacgcagcuacugcuaugaagccucgauauccgacauggcaucagacucccggugccccacccagggagaagcauaccucgacaaacaauccgacacccaguacguuuguaaacgcacacuagucgacagaggcuggggaaacggcugcggccuauuuggcaaaggcagccuggucacaugcgcaaaauucgccugcagcaaaaaaaugaccggaaaaagcauacaaccagaaaaccuggaauaccgcauaaugcuguccguccacggaagccaacacucaggcaugaucguaaacgacaccggccacgagaccgacgaaaacagagcaaaagucgaaaucacaccgaacagcccacgagccgaagcaacccucggaggguucggcucguuaggacucgacugcgaaccaagaaccggacucgacuucucagaccucuacuaccuaacaaugaacaacaaacacuggcucguccacaaagaaugguuccacgacauaccacucccauggcacgccggagccgacaccggcaccccacacuggaacaacaaagaagcccucgucgaauucaaagacgcccacgccaaacgacaaaccguaguaguccucggaagccaagaaggcgcuguacacacggcccucgcaggggcgcuggaagccgaaauggauggcgcaaaaggaagacuaagcuccggccaccuaaaaugccgucucaagauggacaaacugcgccucaaaggcgucucauauagccuaugcaccgccgcuuucacauucacaaaaauacccgccgaaacacuccacggcacaguaacagucgaaguacaauaugccggcacagacggcccaugcaaagucccagcccaaauggccgucgacaugcaaacccucacaccagucggccgccuaaucacagcaaaccccguaauaacagaaagcacagaaaacucaaaaaugaugcuagaacuggacccccccuucggcgauagcuacauagucaucggaguuggcgaaaaaaaaauaacacaccacuggcaccgcuccggcuccacgaucggcaaagcauucgaagcaacgguacgaggagcaaaaagaauggcaguacuaggagauacugcaugggacuucggcuccguggggggggcacuaaacucccuaggcaaaggcauccaccaaaucuucggcgcagccuucaaaucacucuucggcgggauguccugguucagccaaauccucaucggcacccuacuaauguggcuugggcuaaauacgaagaacggaagcauaucccucaugugccuagcacuaggcggcguccucaucuuccuuagcaccgcaguauccgcagacguaggcugc

SEQ ID NO: 2791 - RNA, 2097 nt, Artificial Sequence
  ZIKV prME variant CDS opt
gaaaagaaaagacgaggagcagacaccagcgucggcaucgucggucuacuacucacaacagccauggccgcagaagugaccagacggggaucggcauacuacauguaccucgaccguaacgacgcaggagaagcaaucucauucccaaccacacucggcaugaacaaaugcuacauccaaauaauggacuuaggacacaugugcgacgccacgauguccuacgaaugcccgaugcuagaugaaggaguggaacccgacgacgucgacugcuggugcaacaccacgagcacguggguaguauacggaacaugucaccacaaaaagggugaagccagacgcucccgacgggcggucacccuucccucacacagcacaagaaaacugcaaacucgcagccaaacauggcuggaaucacgcgaauacacaaaacaccuuauacgggucgaaaacuggaucuuccgaaacccaggauucgcacuagcagcggccgccauagccuggcuacuaggcagcaguacuucacaaaaaguaauauaccuagucaugauacuccugauagcccccgcuuacuccauccgaugcaucggaguaagcaauagagauuucguugaaggaaugucaggaggaacauggguagacauaguccucgagcacggcggcugcguaaccgucauggcacaggacaaaccaaccguggacauagaacuggucacaacaacugucagcaacauggccgagguacgcaguuacugcuacgaggcauccaucuccgacauggcaucggacagccgaugcccgacccaaggagaggcauaccucgacaaacaaagcgacacgcaauauguauguaaacgaaccuuaguagaccgcggauggggcaacgguugcggacucuucggaaaaggcucccuggucacaugcgcaaaguucgccugcuccaagaaaaugacgggaaaaagcauccaaccggaaaaccuagaguaccgaaucaugcugucuguccacggaucccagcauuccggcaugaucgucaacgacacuggacacgaaacagacgaaaaccgagccaaaguggagauaaccccaaacagcccaagagcagaggcaacccuaggaggauucggaucccuaggacuggacugcgaaccgcgcacuggacucgacuucucagaccuauacuaccuuacaaugaacaacaaacacuggcucguccacaaagagugguuccacgauaucccccuacccuggcacgccggcgcagacacaggaacaccacacuggaacaacaaagaagcccuagucgaguucaaagacgcgcacgccaaacggcaaacaguagucguccucggaagccaagaaggggcuguacauaccgcacucgccggcgcccuagaagccgaaauggacggcgcgaaaggacgacuaagcucaggacaccucaaaugccggcucaaaauggacaaacucagacucaaaggaguuuccuacucccuaugcacagcagccuuuaccuucaccaaaauacccgcggaaacccuccacggaaccgucacagucgaaguccaauaugcgggaaccgacgggcccugcaaagugcccgcccaaauggccgucgauaugcaaacccucacccccguaggccgacuaaucacagccaaccccguaauaaccgagucaacagaaaacuccaaaaugaugcuagaacuagaucccccauucggagacagcuacauaguaaucggcguaggcgaaaagaaaaucacccaccacuggcaccgauccggaagcacaaucggaaaagccuucgaagcaaccguccguggcgccaaaagaauggccguacuuggagacacagcaugggacuucgggagcgucggaggagcacugaacagccucggaaaaggaauccaccaaaucuucggcgcagcguucaagagccuauucggcgggaugagcugguucucacaaauacuaaucggaacacugcucauguggcuaggccuaaacaccaaaaacggaucaaucagccucaugugucucgcgcugggaggaguacugaucuuccuaucaacagccguaagugccgacgucggcugc

SEQ ID NO: 2792 - RNA, 2094 nt, Artificial Sequence
  ZIKV prME variant CDS opt
aaaaaaagacggggugccgacaccucgguaggaauaguaggacuccuacucaccaccgccauggcagcagaaguaacacgccgaggcagcgccuacuauauguaccucgacagaaacgacgccggcgaagccaucuccuuccccaccacacucggcaugaacaaauguuacauccaaauaauggaucucggccacaugugcgacgcaaccaugucauacgagugcccaaugcucgacgaaggagucgaacccgaugacguagacugcuggugcaauaccaccuccacaugggucguauacggaacuugccaccauaaaaaaggagaagcaagacgaucacggagagccgucaccuuacccagccauuccacccggaaacuacaaaccagaagccaaacguggcucgagagccgggaauauacaaaacaccucauaagagucgaaaauuggauauucagaaaccccggauucgcccucgccgccgcagccauagccuggcuacucggauccagcacaagccagaaagucauauaccucgucaugauacugcuaauugccccagcuuauuccauccggugcauaggcgucaguaaccgggacuucguagaaggaaugucaggagggaccuggguagacaucgugcuagaacacggaggcugcguaaccgucauggcacaagacaaaccaacagucgacauagaacugguaaccacuacagucagcaacauggccgaaguacgaucauacugcuaugaagcaucaaucagcgacauggcaagcgacagucgaugccccacgcagggcgaagccuaccuagacaaacaaucagacacacaauacgugugcaaacggacacuugucgacagaggguggggaaacggcugcggccuauucgggaaaggcagccuaguaaccugcgcgaaauucgcgugcucaaaaaaaaugaccggcaaaagcauccagccagaaaaccuagaauacaggaucaugcucagcguccacggcagccagcacagcgguaugauagucaacgacacuggccacgaaacagacgagaaccgcgcaaaaguggaaaucacaccaaacucaccacgcgccgaagcaacccucgguggguucggcucccuuggacuagacugugaaccaagaaccggccucgacuucagcgaccuauacuaccucacaaugaacaacaaacacuggcucguccacaaagaaugguuccacgacauaccccuaccauggcacgcaggcgcagacacagggacuccacacuggaacaauaaggaagcgcuagucgaauucaaagacgcccacgcaaaaagacaaaccguggucguccugggaucccaagaaggagcagugcacaccgcccucgcaggcgcucucgaagccgagauggauggagcaaaaggaagacuaagcagcgggcaccucaaaugccgacuaaaaauggacaaacuaagacuaaaaggcgucagcuacagcuuauguacggccgccuucaccuucacgaaaaucccugccgaaacccuacacggcaccguaaccgucgaaguccaauacgccggaacagacgggccguguaaaguccccgcccagauggcaguagauaugcaaacacucacccccguaggacgccuaaucacggcaaaccccgucauaaccgaaagcacagaaaacucaaaaaugaugcucgaacuagauccccccuucggagacagcuacauaguaauaggaguaggagaaaaaaaaaucacccaccacuggcacagaucaggaaguaccaucggcaaggccuucgaagccaccgucagaggagccaaacgaauggcgguccucggagacaccgccugggacuucggaagcgucggcggcgcacucaacucacuaggcaaaggcauacaccaaaucuucggagccgccuucaaaagccucuucggcggaaugagcugguucucccaaauacuaaucggcacccuacucauguggcucggucucaacaccaaaaacggcuccauaucccucaugugccuagcacucggaggcguccucaucuuccugagcaccgccgucagugccgacguaggcugu

SEQ ID NO: 2793 - RNA, 2091 nt, Artificial Sequence
  ZIKV prME variant CDS opt
aagaggagaggcgcagauacgaguguagguauaguagggcucuugcucacgaccgcaauggcagccgaagucacaagaaggggcucggcauacuacauguaccuggacaggaacgacgccggcgaagcaauaucguucccaacaacgcuagggaugaauaaaugcuacauacagaucauggaucuagggcacaugugugacgccacaaugucauacgaaugcccgaugcuggaugaaggcguagagcccgacgacguggacugcuggugcaacacgacaagcacauggguagucuacggcacaugccaucacaagaaaggcgaagcgagaagaaguaggagagcaguaacacugccaagccacucaacccgcaagcuacaaacccgaagucagaccuggcuagaaucaagagaguacacaaaacaccugauaagaguagagaacuggauauuccgaaacccaggauucgccuuggcagccgcggcaauagccuggcuauuaggcucguccaccagccaaaaggucaucuaucucgugaugauacuacuaaucgcccccgcauacucaaucaggugcauaggagucagcaaccgcgacuuuguagaggggaugucgggcgggacauggguagacaucguacuagaacacgggggcugugucacagugauggcccaagacaaacccacgguagauaucgaacucgugaccacgacaguuagcaacauggcagaaguuagaucguacugcuacgaagccagcauaagcgacauggccucagacucgcgaugcccaacgcaaggggaggcauaccuggacaaacaaucagacacccaauacgucugcaaaagaacccuagucgaccgaggcuggggcaacgggugcgggcuauucggcaaaggcagccugguaacaugugcuaaauucgcaugcagcaaaaagaugacaggcaaaaguauacagccagagaaccuggaguacaggaucaugcuaagcguccacggcagccaacacagcggcaugaucgucaacgacacaggccacgaaacugacgaaaaccgagccaaaguagagauaacacccaacagcccgcgcgcagaggcaacacugggcggguucgggagccugggacuagacugcgaaccgagaacgggccuggacuucagcgaccucuacuacuuaaccaugaacaacaaacacuggcuaguccauaaagagugguuccacgacauaccacuaccauggcacgcaggcgcagacaccgggacaccacacuggaacaacaaagaagcccuggucgaguucaaggacgcacacgccaaaagacagacagucgugguccugggcucgcaagaaggagccguccacaccgcccucgcgggagcacuagaagccgagauggacggggccaaagggcgacugagcucgggacaucucaaaugccgccuaaagauggauaaacuccgccucaaaggcguaucauacagcuuaugcaccgcggcauucacauucacaaagauccccgccgagaccuugcacgggaccgugacaguagaagugcaauacgccggaacggauggaccaugcaaagucccagcacaaauggcagucgacaugcaaacccuaaccccaguaggacgccuaauaacggcaaaccccgucaucacagaaucaaccgaaaacuccaaaaugaugcuggaacuagacccaccguuuggcgauagcuacaucguaaucggaguaggagaaaagaaaaucacacaucacuggcaccgaagcggcagcacaaucggcaaagcauuugaagcaacaguacggggcgcaaaacgaauggcaguacuuggagacaccgcaugggauuucgggagcguaggaggggcccugaacucgcuagggaaaggaauccaccaaauauucggggccgcguucaagagccuuuucggaggaaugagcugguucagccaaauucucauagggacgcuccugauguggcucgggcuaaacaccaaaaacggcucaaucagcuuaaugugccuagcacuaggaggcguccuaauauuccuaagcacagccguaagcgcagacguaggcugc

SEQ ID NO: 2794 - RNA, 2088 nt, Artificial Sequence
  ZIKV prME variant CDS opt
cgccguggugcagacaccucaguaggaaucguaggccuucuccuaaccacagcuauggccgcagaagucacacgacggggaucggccuacuacauguaccucgaccgcaacgacgccggcgaagcaaucagcuucccaaccacccugggcaugaacaagugcuacauacaaauaauggaccucggccacaugugcgacgcaacgaugucauaugaaugccccaugcucgacgaaggaguagaacccgacgacguagacugcuggugcaacaccaccagcaccugggucgucuauggaaccugccaccacaagaaaggcgaggcccgcaggucccgacgcgccguaacgcuacccagccacucaacucgcaaacuacaaaccagaagccaaaccuggcuagaaucccgagaauacacgaaacaccucauaagagucgaaaacuggauauuccgcaacccaggcuucgcccuggcagcagcagcaaucgccuggcuccuaggcagcagcaccucccaaaaaguaauauaccuuguaaugauacugcucauagcacccgcauacagcauacgaugcaucggagucagcaacagagacuucgucgaaggcaugagcggaggcacauggguagacaucguccuagaacacggagggugcgucacgguaauggcacaggacaaaccaacagucgacaucgaacucguuaccacaaccguaagcaacauggcagaggucagauccuacugcuacgaagcauccauaagcgacauggcauccgacagccgaugcccaacccaaggcgaggcuuaccuagacaaacaauccgacacccaguacguaugcaagcgaacucuagucgauaggggauggggcaacggaugcggacucuucggcaaaggcuccuuagugacaugugcaaaauucgccuguagcaagaaaaugaccggcaaaagcauccaaccagaaaaccuggaguaccguauaaugcucagcguacacggaagccaacacagcggcaugauagucaacgacacaggacacgaaacagacgaaaaccgugccaaaguagaaaucaccccaaacagcccacgagcugaagccacccuaggaggcuucggaagccugggacuagacugcgaaccccgcaccggccucgacuucuccgacuuauacuaccugacaaugaacaacaaacacuggcuaguacacaaagagugguuccaugacaucccacuacccuggcacgcaggagccgacaccggcacaccgcacuggaauaauaaagaagcgcucguagaguucaaggacgcccacgccaagcgacaaaccgugguaguccugggcagccaagaaggagcaguccacaccgcccuagcaggagcacuagaagccgaaauggacggagcaaaagggcgacucagcucaggacaucucaaaugccgccugaaaauggacaaacuccggcucaagggagucagcuacagccugugcaccgcagccuucaccuucaccaaaauacccgcagaaacccuccacggcaccguaacaguagaaguccaauacgcaggaaccgacggacccugcaaaguaccagcccaaauggcaguagacaugcaaacacucacacccgucgguagauuaauaacagccaacccagucauaaccgaaucgacugaaaacaguaaaaugaugcucgagcuagaucccccauucggggacagcuacauaguaaucggagucggcgagaaaaagaucacacaucacuggcaccgcagcggcagcaccaucggcaaggcuuucgaagcaacaguacgcggggcaaaacggauggccguccuaggcgacacagccugggacuucggcuccguaggcggggcacucaacagccuagggaaaggcauccaccaaaucuucggagccgccuucaaaucgcuguucggaggaaugagcugguuuagucaaauacuuauaggcacccuacucauguggcucggacuaaauaccaaaaacgguuccaucagccucaugugccuagcccuaggcgggguacugaucuuccucucaaccgccgucuccgccgacguaggcugu

SEQ ID NO: 2795 - RNA, 2085 nt, Artificial Sequence
  ZIKV prME variant CDS opt
agaggagcugacacgagcgucggcauagucggacuccuccuaaccacagccauggcagccgaaguaacacgacguggauccgccuacuacauguaccuggacagaaacgaugcaggcgaagcuaucagcuuccccaccacccucggcaugaacaagugcuacauacagaucauggaccuaggccacaugugcgacgcgacgaugagcuacgaaugcccgaugcucgacgaaggcguggaacccgacgacgucgacugcuggugcaacacaaccagcaccuggguugucuacggcacgugccaccacaagaaaggagaagcacgccgaucccgcagagccguaacccuacccucacauuccacaagaaaacuacaaacccgaagccaaacauggcuagaaagccgcgaguacacaaaacaccuaauaagaguagaaaauuggauauuccgaaaccccgguuucgcccucgcagccgccgcgaucgccuggcuacuaggauccuccacuagccaaaaaguaaucuaccucgucaugauacuacucauagccccagccuacuccauccgcugcaucggagugucaaacagggacuucguagaaggcaugagcggaggcacgugggucgacaucguacuagaacacggcgggugcgucacagugauggcccaggacaaaccaaccguagacaucgagcuagucacgaccacaguaagcaacauggcugaagucagaucguacugcuacgaagccuccaucuccgacauggcauccgacucccgcugcccaacccaaggcgaagcauaccucgacaaacaaucggacacccaauauguaugcaaacgcacacucguagacagaggauggggcaacggcugcggacuauucggaaaagggagccuagucacuugugccaaauucgccugcagcaagaaaaugaccggaaaaaguauccaacccgaaaaccuagaauaccgcaucaugcucuccguccauggaucccaacacagcggcaugaucguaaacgacaccggccacgaaacagacgaaaaccgcgccaaagucgaaaucacccccaacuccccaagagcagaggccacccugggaggauucggaucacuaggccucgauugcgaaccgcggaccggccuagacuucucagaccuguauuaccuuaccaugaacaacaagcacuggcucguacacaaggaaugguuccacgauauaccacuacccuggcacgccggcgccgacacaggcacaccccacuggaacaacaaagaggccuuagucgaguucaaagacgcccacgcaaagcgucaaaccguagucguacuuggaucgcaagaaggcgccguccacaccgcccucgcaggggcccucgaagcagaaauggacggcgcgaaagggcgccuauccagcggacaccucaaaugcagacuaaaaauggauaaacuccgccugaaaggcgucucauacucccucugcaccgccgccuucaccuucacaaaaauccccgcagaaacccuccacgggacaguaaccgucgaaguccaguacgccggaacagacggacccugcaaaguaccugcgcaaauggcaguagacaugcaaacccuaacccccgugggacgacuaauaacggcaaacccagucauaaccgaauccacagaaaacucaaaaaugaugcucgagcucgacccacccuucggcgacagcuacaucgucaucggagucggagagaaaaagauaacacaccacuggcacagauccggcagcacgaucggcaaagcauucgaagccaccguacguggagcuaaacgcauggcaguccucggagauacagccugggacuucggcuccgucggaggcgcccucaacagccuaggcaaaggaauacaccaaauauucggugcagcauucaagucccucuucggcggcaugagcugguucucacagauccucauugggacccuacucauguggcuaggucuaaacaccaaaaacggcuccaucucccucaugugccuggcacuagguggcguacucaucuuccucucgaccgcgguuucagccgacgucgggugc

SEQ ID NO: 2796 - RNA, 2082 nt, Artificial Sequence
  ZIKV prME variant CDS opt
ggcgcggacacaagcgucgggaucguaggccuucugcucacgaccgccauggcagccgaagucacgcgacggggaucggccuacuacauguaccuugacagaaacgacgccggugaagcaauauccuucccuaccacccucggaaugaacaaauguuauauacagaucauggaccucggccacaugugcgacgcaaccaugucauacgaaugccccaugcuagacgaaggaguggagccagacgacguggacuguuggugcaacacaacgagcacauggguaguuuacggaacaugccaucacaagaaaggagaagcuagaagauccagacgcgcagucacacuaccaucccacagcacgcgcaaacuccagacacgcagccaaacauggcuggagucaagggaauacacaaaacaccucauacgagucgagaacuggaucuuccgcaaccccggauucgcacucgcagccgcagcaauagcauggcuucucgggagcuccaccagccaaaaaguaaucuaccucguaaugauacuccuaaucgcaccagcguacuccauaagaugcauaggcguaagcaaccgagacuucgucgaaggaaugagcgguggaacguggguugacaucguacuggaacacggggguugugucacggucauggcacaagacaaaccaacgguggacaucgagcuaguaacaacgaccgucagcaacauggcagaaguccgauccuacugcuacgaagcaucaaucagcgacauggccucagacucccgaugccccacccaaggagaagccuaccuagacaagcaauccgacacucaauacgucugcaaaagaacgcuagucgaccguggauggggaaacggcugcgggcuauuuggaaaaggaucucuagucacuugcgcaaaauucgcguguagcaagaaaaugacaggaaaaagcauacaaccggaaaauuuagaauacaggauaaugcucuccguccacggcucccaacauagcggcaugaucgucaacgacacaggucacgaaacagacgaaaacagggccaaaguagaaaucacccccaacucaccgcgcgcagaagcaacacugggcggcuucggcucacuaggccucgacugcgaaccacgcacuggcuuagacuucagcgaccucuacuaccugacaaugaacaauaaacacuggcuaguccacaaagaaugguuccacgacauaccgcuaccauggcaugcaggagcggacacaggcacaccacacuggaacaacaaagaagcccucgucgaguucaaagacgcccacgcaaaaagacaaacggucguaguccuaggcucccaagagggggcaguacacacagcacucgcaggagcacucgaagccgagauggacggagcgaaaggccgacuaucaucgggacaccucaaaugcaggcucaaaauggacaaacugcggcuaaaaggagucuccuacucacucugcacagcggccuucacuuucaccaaaaucccagccgaaacccuacacggcaccgucaccguggaaguacaauacgccggcaccgacggcccgugcaagguaccagcccaaauggccguagacaugcagaccuugaccccaguaggaagacuaaucacagccaacccggucauaacagaaagcaccgagaacuccaaaaugaugcuggaacuggacccacccuucggagacagcuauaucgucauaggaguuggagagaaaaagaucacccaccacuggcaccgaagcggaucaaccaucggcaaagccuucgaagccacaguccgaggcgcaaaaagaauggccguccuaggcgacacggccugggacuucgggaguguagguggagcacucaacucacucggaaaaggcauccaccaaauauucggggccgccuucaagagccuauucggaggcaugagcugguucucgcaaauacuaaucggcacacugcucaugugguuaggccuuaacacuaaaaacggcaguaucagccuaaugugccucgcacucggaggcgugcucauauuccugagcacagcagugagcgcggacgugggaugc

SEQ ID NO: 2797 - RNA, 2079 nt, Artificial Sequence
  ZIKV prME variant CDS opt
gcagacaccagcgucggcauaguagggcuacuacucacaacagcaauggcagccgagguaacacggcgcggcucagccuauuacauguaccucgacagaaacgacgcaggagaagcaaucagcuuccccaccacgcuaggcaugaacaaaugcuacauacaaauaauggaccuaggccacaugugcgacgcuacaaugaguuacgaaugcccaaugcuggacgaaggcguagaaccagacgacgucgacugcuggugcaacaccacuagcaccugggucgucuacggaaccugccaccauaagaaaggggaagcgcgccgcagccggcgagcgguaacacuccccagccacagcacgcgcaaacuccagacccgcagccagacauggcuagaauccagagaauacaccaaacaccuaauaagaguagagaacuggaucuuccgcaacccaggauucgcccucgccgccgcagccauagccugguuauuaggcuccuccacaagccagaaaguaaucuaccucguaaugauacuccuaaucgcacccgcauauuccauaagaugcauaggcguaagcaaccgcgacuucguugaagggaugucgggcggaaccugggucgacaucgugcucgaacacggaggaugcgucacggucauggcccaagacaaacccaccgucgacaucgaguuagucacuacaacaguguccaacauggccgagguacgcuccuacugcuacgaagcaagcauauccgacauggccuccgacagucgcugcccaacacagggagaagcauaccucgacaaacagagcgacacacaauacguaugcaaacgaacccuaguagaccgaggauggggcaacggaugcggacuauucggcaaaggcucccuagugaccugcgcaaaauucgcaugcucaaagaaaaugacgggaaaaagcauacaaccagaaaaccucgaguaccgaauaaugcuaucgguccacggcagccaacacagcggaaugauaguaaacgauaccggacacgaaacagacgaaaacagagccaaaguagagauaacucccaacagcccacgagcugaagcgacucugggaggauucggcagccugggccucgacugugaaccgcgcaccggccuagacuucucagaucuuuauuaccucacuaugaauaacaaacauuggcucguacacaaagaaugguuccaugacauaccacuaccauggcacgccggagcagacaccggcaccccacacuggaacaacaaagaggcccucguagaguucaaagacgcccacgcgaaacgacaaacagucgugguucuaggcucacaagaaggagcgguccacaccgcgcuagcuggcgcacucgaagcagaaauggacggagcaaaaggacggcucagcuccggccaccucaaaugccgacuaaaaauggacaagcuccggcugaaaggagucagcuacucccucuguaccgccgccuucaccuucacaaaaaucccagcagaaacacuacacggcacaguaacaguagagguccaauacgcggggaccgacgguccaugcaagguaccagcccaaauggcaguagacaugcagacccuaacgcccguaggacgccugauaaccgcaaacccaguaauaaccgaaagcaccgaaaacagcaaaaugaugcuggaauuagacccgccauucggcgacagcuauaucgucauuggcgucggcgaaaagaaaaucacccaccacuggcaccgcaguggauccacaauaggaaaagcauucgaggcaaccguacgaggcgcaaaacgaauggccguccucggagauacagcgugggacuucggcuccgucggcggagcacucaacagccuagggaaagguauacaccaaauauucggcgcagcuuucaaaagccuauucggaggaaugagcugguucagccaaauacuaaucggcacacuccucauguggcucggacucaacaccaaaaacgggagcauaagccucaugugccuggcgcucggaggcguacucaucuuccucucaacggcaguaagcgcagacgugggaugc

SEQ ID NO: 2798 - RNA, 2076 nt, Artificial Sequence
  ZIKV prME variant CDS opt
gacaccuccgucggcauagugggacuccuccuuacuaccgccauggcagcggaaguaacccgacgcggcucagcauacuacauguaccuggaccgcaacgacgcaggcgaggccaucagcuuucccaccacccugggaaugaacaaguguuacauacaaaucauggaccucggccacaugugcgacgcaaccaugagcuacgaaugcccaaugcucgacgaaggaguagaacccgacgacguagacugcuggugcaacacaaccucgacaugggucguauacggaaccugccaccacaagaaaggcgaggcccgccguucacgccgagccgucacacuaccaucccacuccacaagaaaauuacaaacgcgcucacaaacauggcucgaguccagagaauacaccaaacaccuaauccgaguagaaaacuggaucuuccgaaaccccggcuucgcccucgccgcagccgcaauagcguggcuccucgguuccagcaccucccaaaaagucaucuaccuaguaaugauacuacuaaucgcuccagcuuacuccauaagaugcauaggcguauccaaccgggacuucgucgaaggcaugaguggcggcacaugggucgacaucguccuagagcacgggggcugcguaacagucauggcccaagacaaaccaacggucgacauagaacucgucaccaccacagucucaaacauggcagaaguccgcuccuacugcuacgaagcgagcaucagugacauggcaucagacagccgcugcccaacccaaggagaagccuaccuagacaaacaauccgauacucaauacgucugcaaaagaacauuaguggacagaggcuggggaaacggcugcggccucuuuggaaaaggcagccuaguaacaugcgccaaauucgcuugcucuaagaaaaugaccggcaaaucaauccaacccgaaaaccuggaguaucgcaucaugcuaagcguacacggcagccaacacagcggaaugauaguuaaugacaccggccacgaaacagacgaaaaccgcgcaaaagucgaaaucacccccaacucaccccgcgcagaagccacccuaggcgguuucggcucacucggcuuagacugcgaaccacguacaggacuagacuucucagaccuguacuaccucaccaugaauaacaagcacuggcucguccacaaagaaugguuccacgacauaccccugccauggcacgcgggagcggacaccggcacaccccacuggaacaacaaagaagcccuaguggaguucaaagacgcccacgcaaaacgccaaaccguagucguucucggaagucaggaaggggccguccacacagcccuagccggagcccucgaagcagaaauggacggugcgaaagggcgacucuccucuggacaccucaaaugccgcuuaaaaauggacaaacuacggcucaaaggagucuccuacagccucugcacggccgccuucaccuucacaaaaauccccgccgaaacacuccacggaacagucacaguagaaguccaauacgccggaaccgacggccccugcaaagucccagcacaaauggcagucgacaugcaaacacucacacccguaggcagacucaucaccgccaacccagucauaacagaaucaacagaaaauuccaagaugaugcuggaacucgaucccccauucggcgacucauauaucgucauaggagugggagaaaagaaaaucacacaccacuggcaucgcucaggaagcaccaucggcaaagcauucgaagcuaccguccgaggagcgaaacggauggccguacuaggcgacacggccugggacuucggcuccguaggcggagcccucaauucccuagggaaaggcauccaccaaaucuucggcgccgccuucaaaucccuauucggcggcauguccugguucagccaaauacuaaucggaacacuacucauguggcuaggacucaacaccaaaaacggcuccaucagccucaugugccuagcucugggcggaguccucaucuuccucagcaccgcuguauccgccgacgucggcugc

SEQ ID NO: 2799 - RNA, 2073 nt, Artificial Sequence
  ZIKV prME variant CDS opt
accagcgucgguaucguaggccuacuacuaacgaccgcaauggcugccgaaguaacaagacgcggcagcgcguacuacauguaccucgaccgaaacgacgcaggcgaagcaaucagcuucccgaccacacuaggcaugaacaaaugcuacauacaaauaauggaccucggucauaugugcgacgcaacaaugaguuacgaaugcccaaugcucgacgaaggaguagagcccgacgacgucgacugcuggugcaacaccaccagcacaugggucgucuacggaacgugccaccacaagaaaggcgaagcccgcagaucccgccgcgcagucacccuccccagccacucaacgagaaaacuccagacccggucacaaacguggcucgaaucccgagaguacacaaaacaccucauacgcguggaaaauuggaucuuccgcaaccccggcuucgcacucgccgcagccgccauagccuggcuacucggauccucaacaucccaaaaagucauauacuuaguaaugauccuacucauagcaccagcuuacagcauccgcugcauaggcguauccaacagagacuucgucgaaggaaugagcggcggaaccuggguagacauaguccuggaacacgggggaugcguaaccgugauggcacaggacaaacccacagucgacauagaacucgugacaacaacgguaaguaacauggcggaaguucgcagcuacugcuacgaagccucaaucuccgacauggcaagcgacucacggugcccaacgcagggcgaagccuaccuagacaaacagucagauacacaauacgucugcaaacgaacccucguagaccggggcuggggcaacggaugcggccucuucggaaaaggaucacucgucacaugcgcaaaguucgcaugcaguaagaagaugacgggcaaaagcauccagccagagaaccucgaauaccgcauuaugcucucaguccacggaucccaacacucaggcaugaucgugaacgacacaggacacgaaacagacgaaaaccgagcgaaaguagaaauaaccccaaacagccccagagcagaagcaacccucggcggcuucggcagucucggacuagacugcgaaccaagaacaggccucgacuucagcgaucuguacuaccuaacgaugaacaacaaacacuggcucguacacaaagaaugguuccacgacauaccacucccguggcacgcaggagcagacacgggcacaccccauuggaacaacaaagaggcccuagucgaguucaaggacgcccacgccaaacggcagaccgucgugguacuaggcucacaagaaggagcagugcacacagcacuagcaggagcacuugaggcagaaauggacggcgccaaaggucgacugucaagcgggcaccuaaaaugucgccuaaaaauggacaaacuacgccucaaaggcguaagcuauagccucugcaccgcagcguucacguucacgaaaauaccggcagagacccuacacggcacaguaacgguugaaguccaauacgccggcaccgacgggccaugcaaagucccggcccaaauggccgucgacaugcaaacgcuaacaccggucggacgccucaucacagccaacccggucaucacagaaagcacagagaacaguaaaaugaugcuagaacuagacccacccuucggcgacucauacaucguaauaggcguaggagagaagaaaauaacccaccacuggcacagaagcggcaguaccauaggcaaagcauucgaagcaaccguaagaggcgccaaacgcauggcaguacuaggcgacaccgccugggacuucggcagcguaggaggagcccuaaacucccucggcaaaggcauacaccaaauauucggcgcagccuucaaaagccucuucggcgggaugagcugguucucccagauacuaauaggcacccuacuuauguggcuaggacuaaacaccaaaaacggaagcaucagccucaugugccucgcacucggcggaguacuaaucuuccucuccacagcggucucagcagacgucggcugu

SEQ ID NO: 2800 - RNA, 2073 nt, Artificial Sequence
  ZIKV prME variant CDS opt
accucaguuggaaucgucggccuacuucugacaaccgccauggcagccgccgucacacgcaggggcucagcauauuacauguaccuggaccgaaacgacgccggggaggccaucuccuuccccaccacccucgggaugaacaaaugcuacauccaaauaauggaccugggccacaugugcgacgcgaccauguccuacgagugccccaugcucgacgagggaguagaacccgacgaugucgacugcuggugcaacaccacgagcaccuggguggucuacggaacgugccaccacaagaaaggcgaagcccgacgcucccgcagggcggugacccuacccagccacagcacacggaaacuacaaaccaggucccagacauggcucgaguccagagaauacaccaaacaccuaauucgcgucgaaaacuggaucuucagaaacccaggauucgcccuagccgcagccgccaucgcauggcuccucggcucaagcacaagccaaaaagucaucuaccuagucaugauacugcuaaucgcccccgccuacucaauccgcugcaucggaguaucaaaucgcgauuucguugagggaaugagcggaggcaccugggucgacaucguccucgaacacggcggcugcguaacagucauggcucaagacaaaccaacaguagacaucgagcuaguaacaaccaccguaagcaacauggcagaaguacggucauacugcuacgaagcaucuauaucagacauggccucagacucacgaugcccaacucaaggggaagcauaucucgacaaacaaagcgacacccaauauguaugcaaacgaacacucguugacagaggcuggggaaacggcuguggccucuucggcaaaggcucccuugucacaugcgcaaaauucgccugcucgaagaaaaugaccggcaaaagcauacaaccagaaaaccuggaauacagaauaaugcugagcguacacggcucgcaacauagcggcaugauaguaaaugacaccggacacgaaaccgacgaaaaccgagccaaaguagaaaucacccccaauucuccccgcgccgaagccacucugggaggcuucggaucccuaggccucgacugcgaaccaagaaccggacuagacuucucagaccuauacuaccuaacaaugaacaacaaacacuggcuuguccacaaagaaugguuccacgacaucccccuacccuggcacgcaggcgccgacacaggaacgccccacuggaacaacaaagaagcacucguagaguucaaagacgcccacgcgaaacgccaaaccguagucguccugggcucacaagaaggagcaguccacaccgcgcucgccggugcacucgaagcagaaauggacggcgccaaaggccgacuaagcuccggccaucuaaaaugccgucuaaaaauggacaaacuccgccuaaaaggagucagcuacucacuguguacagcagccuucaccuucaccaaaaucccggccgagacgcuacacggcaccgucaccgucgaaguucaguacgcagggaccgacggacccugcaaaguccccgcccaaauggcgguagacaugcaaacccugaccccggucggaagacuuauaaccgcaaaccccguaaucaccgaaucaaccgagaacagcaaaaugaugcuggagcuagacccacccuucggcgacuccuacaucguaaucggcgucggcgaaaagaaaauaacccaccacuggcaccgaucgggaucaaccauaggaaaagcguucgaagcaaccguccgcggagcaaaacggauggccgugcuaggagacacagcaugggacuucggaagcguaggaggcgccuuaaacucacuaggcaaaggcauacaccaaaucuucggcgccgccuucaagagcuuauucggaggcaugagcugguucucccaaauccuaaucggcacacuccucauguggcugggacucaacaccaaaaacgggagcauaucgcucaugugccucgcccuggguggcguccuaaucuuccuaucgacagccgucuccgccgacgucggcugc

SEQ ID NO: 2801 - RNA, 2085 nt, Artificial Sequence
  ZIKV prME variant CDS opt
cgcggcgccgacaccagcguaggcaucgucggacuacuccucaccacagccauggcagccgcaguaacacgacgaggaucagccuacuacauguaccuggacagaaaugacgccggcgaagccaucagcuuuccaacaacucucgguaugaacaagugcuacauacaaauaauggaccucggccacaugugcgacgcaacaaugagcuacgaaugccccaugcuagacgaaggggucgagcccgacgacguagacugcuggugcaacaccaccucaaccugggugguauacggaacaugccaccacaagaaaggcgaagcucgacgcagcagacgagccguaacacucccaagccacagcacaagaaaacuccaaaccagaagccaaacauggcucgaauccagagaauacacaaaacaccuaauuagaguagaaaacuggauauucagaaaccccgguuucgcacucgccgccgccgcaauagcauggcuacucggaagcuccaccucgcaaaaagugaucuaccucgucaugauccuacuaaucgcaccagccuacuccaucagaugcaucggagucuccaaccgagacuucgucgaaggaaugagcggcggaaccuggguagacaucgugcuagaacacggcggaugcgucacuguaauggcacaagacaaaccaacagucgacaucgaacucguaaccacaacggucuccaacauggccgaaguccgauccuacuguuacgaggccagcauaucagauauggcauccgacagccgaugccccacccaaggcgaagccuaccuagacaaacaaagcgacacccaauacguaugcaaacgcacccucguugacagaggcuggggaaacggaugcgggcuauucggcaagggcucacucgucacaugcgccaaauucgccugcagcaaaaagaugaccgggaaaagcauacaacccgaaaaccuagaauaccgaaucaugcuaucagugcacgggucacagcauagcggcaugaucgucaacgacaccggacacgagacggacgaaaacagggccaaagucgagaucacccccaacucaccgcgcgcagaagccacgcucggcggauucggcucauuaggacuggauugcgaaccacguaccggccucgacuucuccgaccucuacuaccucacaaugaauaacaaacacuggcugguacacaaagaaugguuccacgacauaccccuacccuggcacgccggagccgacacaggcacaccgcacuggaacaacaaggaagcccucgucgaguucaaagacgcccacgcuaaaagacaaaccgucgucguacuaggaagccaagaaggcgcagugcacaccgcgcuggcgggcgcacuugaagccgaaauggauggagcaaaaggaagacuaagcuccggacaccugaaaugucgccuaaagauggacaaacuaaggcuaaaaggcguaucguacucacucugcacagcagcauucacuuucacaaaaauacccgccgaaacgcuccacggcaccguaacagucgaaguccaauacgcgggaaccgacggcccaugcaaaguccccgcccaaauggccguggacaugcagacccuaaccccggugggccgccuaauaacagcaaaccccguaaucacugaaagcaccgaaaauucaaaaaugaugcucgaacucgacccacccuucggagacagcuacauagugauaggaguaggagagaaaaagauuacccaccauuggcacagaucaggcagcacaaucggaaaggcuuucgaagcaaccguacgcggagcaaaacgcauggcgguacucggcgacacagccugggacuucggcagcgucggcggcgcacuaaacuccuuaggaaaggguauccaccaaaucuuuggcgcagccuucaaaagccucuucggcggcaugagcugguucucacaaauccucauaggcacacuccucauguggcucggcuuaaacaccaaaaacggauccaucagccuaaugugccuggcacucggcggcguccuaaucuuucuaucaacugccgucagugcagacguaggaugc

SEQ ID NO: 2802 - RNA, 2109 nt, Artificial Sequence
  ZIKV prME variant CDS opt
cgaggccucagcuccagaaaacgacgaucacacgacguccucacgguacaauuccucauacuagguaugcuacucaugaccggaggagugacacgcagaggcagcgccuacuacauguaccucgaccgcaacgacgcaggagaggccaucagcuuccccacaacccuaggcaugaauaaaugcuacauccaaaucauggaccuaggccacaugugcgacgccacaaugucauacgaaugccccaugcuugacgaaggaguagaacccgacgacguagacugcuggugcaacacaaccagcaccugggucguauacggaacgugccaccacaagaaaggugaagcacgaagaagccgaagggcagucacccuucccagccacucaaccagaaaacuccaaacacgaucccaaaccuggcuagagagccgcgaguauacgaaacaccucauccgcgucgaaaacuggaucuucagaaacccaggcuucgcgcucgcugcagcagcaauagcauggcuccugggaagcagcaccucgcaaaagguuauauaccuagucaugauacuacugauagcacccgccuacagcauacgcuguaucggaguauccaacagagacuucgucgaaggaauguccggaggaacauggguagauauagugcucgaacacggugggugcguaaccgucauggcccaggacaaacccaccgucgacauagaacucgucacaaccacgguaucaaacauggccgaaguacgaucauacugcuacgaagcaagcauuagcgacauggcguccgacucaaggugcccaacccaaggagaagcauaccuagacaaacaaagcgacacgcaauacgugugcaagcgaacccuuguagacagaggaugggggaacggaugcggccucuucggaaaaggcagccuaguaacaugcgcaaaauucgcaugcagcaagaaaaugaccggaaaaucgauacaaccagagaaccucgaauacagaauaaugcucagcguccacgguucacagcacagcggcaugauagugaacgacacagggcacgagaccgacgaaaaucgcgcuaaagucgagauaaccccaaacagcccacgagcagaagccacccucgggggcuucggaucacuuggacuagacugcgaaccacgaaccggacuagauuucagcgaccucuacuaccuaacaaugaacaacaaacacuggcucguacacaaagaaugguuccacgauaucccguuaccauggcacgcaggagccgacacaggaacuccccacuggaacaacaaagaagcacucguggaguucaaggacgcucacgcaaaacgccaaaccguggugguccuaggaagccaggaaggagccguucacacagccuuagccggagcacuagaagcggagauggacggggccaagggccgccugagcaguggacaccucaagugccgacugaaaauggacaaacuaagacuaaaaggagucucguacagccuaugcacagcagccuucaccuucacaaagauaccggccgaaacacuacacggcacagugacaguagaaguacaauacgcaggaaccgacggccccugcaaaguacccgcccaaauggcaguagacaugcaaacccucacacccguaggcaggcuaaucacggcgaacccaguuauaacggaaagcacggagaacagcaaaaugaugcuagagcuggacccaccauuuggagacucguacauaguaaucggagucggagaaaagaaaaucacacaccacuggcaccguuccggcagcacgauaggcaaggcguucgaagcaacagucagaggcgccaagaggauggcgguacucggagacaccgccugggacuucggcucagugggcggcgcgcuaaacucacucggaaaaggcauacaccaaauauucggagccgcauucaaaagucuuuucggaggcaugagcugguucagccaaauccugauaggcaccuuacuaauguggcucggcuuaaacaccaaaaacggaaguaucucacucaugugcuuagcccugggcggaguucucauauuccuuagcaccgcagucagcgccgacguugggugc

SEQ ID NO: 2803 - RNA, 2109 nt, Artificial Sequence
  ZIKV prME variant CDS opt
cgcggccucucuagccgcaaacgcagaagccacgacgucuuaacuguacaauucuuaauccucggcaugcugcuaaugacaggggcaguaacacgccgaggauccgcuuacuauauguaccuggaccggaacgacgcaggcgaagccauauccuucccaacaacccugggcaugaacaaaugcuacauacaaauaauggaccuaggucacaugugcgacgcgaccaugagcuacgagugccccaugcucgaugaaggagucgaacccgacgacgucgacugcuggugcaacaccacgucuaccuggguagucuacggaaccugccaccacaaaaagggagaagcacggcgaucuaggcgagcaguaacgcuaccaucacauagcacgcggaaacuccagacacgaucccaaaccugguuagaaagccgagaguacaccaaacaccugauaagaguagaaaacuggaucuucagaaacccaggauucgcucuagcggcagcagccaucgccuggcuccuuggaucaucaacaucucaaaaaguaaucuaccucguaaugauccuccucaucgcaccggcauacagcauacgcugcaucggcgucucaaacagagacuucguagaagggaugagcggcggcacauggguagacauaguacucgaacacggcggcugcguaaccguaauggcgcaggacaaaccaaccgucgacaucgagcuagucacgaccaccgucucaaacauggcugaaguccgaucauacugcuacgaagcaagcaucagcgauauggccuccgacaguagaugccccacccaaggagaagccuaccuugacaaacaauccgacacccaauacguaugcaagcgaacccucgucgaccgcggcuggggcaacggcugcggccuauucggcaaaggcagccucgucacaugcgccaaauucgccugcagcaagaaaaugaccggaaaaucaauacaaccagaaaaccucgaauaccgaaucaugcucagcguccacggcagccaacacuccggcaugauagucaacgacacaggccacgaaacagacgagaaccgugccaaaguagagauaacacccaacaguccccgugccgaagcaacccucggcggcuucggcucccuaggccuggacugcgaaccacgaaccggacuagacuucagcgaccuauacuaccuaacaaugaacaacaagcacuggcugguacacaaagaaugguuccacgacaucccccuccccuggcacgcgggcgccgacacgggaaccccacacuggaacaacaaagaagcccucgucgaguucaaagacgcgcacgcaaaaagacaaacagucgucguauuaggcucacaagaaggcgcaguacacacagcccuagcuggagcccucgaagcagaaauggacggggcaaaaggccgacucagcagcggacaccucaaaugccgccuuaaaauggacaaacuacgacuaaagggagucagcuacucacucugcaccgccgcauucacguucaccaaaauccccgccgaaacccuccacggaaccguaacaguagaaguacaauacgcaggcaccgacggucccugcaaagucccagcccaaauggcaguagacaugcagacacuaacgccuguagggagacuaauuacagcaaacccugucaucacggaaucaaccgagaacagcaaaaugaugcuagaacuagaucccccauucggagacaguuacaucguaauuggagucggagaaaagaagauaacgcaccacuggcacagaagcggcucaacaauaggaaaagcauucgaagccacaguccggggagccaagagaauggccguacugggggacaccgcaugggacuucggaagcgugggcggagcacuaaacagccuaggcaaagggauacaccaaauauucggcgccgccuucaaaucacucuucggaggcaugagcugguucagccagauucuuaucggcacacuacuaauguggcucggccugaacaccaaaaacgguagcauaucacucaugugccuugcccucggagguguacuaaucuuccugagcaccgccgucagcgcagacguaggaugc

SEQ ID NO: 2804 - RNA, 2109 nt, Artificial Sequence
  ZIKV prME variant CDS opt
cgaauaauaaacgcacgaaaagagaagaaaagaagaggcgccgacacaagcgugggaauagucggccuacugcuaacaacagccauggccgccgaagucacgcgucgaggauccgccuacuacauguaccucgaccgaaacgacgccggcgaagccauauccuucccaacaacccucggcaugaacaaaugcuacauccaaauaauggaccugggacacaugugcgacgccaccaugucauacgaaugcccaaugcuagacgaaggcgucgaaccagacgaugucgacugcuggugcaacacaacuagcacauggguaguauacggcacaugccaccacaagaaaggggaagcccgccgcagccggagggccgucaccuuaccaucccacucaacgcgcaaacuccaaacccgaagccaaacauggcucgaaucgcgagaauacaccaaacaccucauccgggucgagaacuggaucuuucgaaaccccggguucgcccuagcggcggcggcaauagcauggcuacucggcucaucaacgucucaaaaagucauuuaucuagucaugauacugcuaaucgccccagcguacucaauacggugcaucggaguaucaaaccgcgauuucguggagggcaugucaggcggaaccuggguagacauagugcuagagcacggaggcuguguuacugucauggcccaggacaaacccaccguggacaucgagcuaguaacaacaaccguauccaacauggcagaaguccguucauacugcuaugaagccuccaucuccgacauggcaucagauagcagaugcccaacacagggcgaagcauacuuagacaaacagucagacacgcaauacguuuguaaacgcaccuuagucgacagaggcugggggaacggaugcgggcuauucggcaagggcucgcuaguaaccugcgccaaauucgcaugcagcaagaagaugaccggcaaauccauacaaccagaaaaccucgaauacagaauaaugcuaucuguccacggcagccaacacagcggaaugauugucaacgacacaggccacgaaacggacgaaaaccgagccaaaguagaaaucacacccaacucaccgcgagccgaagcaacccucgggggcuucggcucccuaggacucgacugcgaaccccggaccggccucgacuucagcgaccucuacuaccuaaccaugaacaacaaacauuggcuaguccacaaagaaugguuccacgacaucccccuuccauggcaugcaggagcagacacaggcacaccccacuggaacaacaaagaagcgcuaguagaguucaaagacgcacacgcaaaacgacaaacagucgucgugcugggaucccaagaaggcgcuguccauacagcacucgcaggcgcacucgaagccgagauggauggcgcaaaaggacgacuaagcuccggacaccucaaaugcagacugaaaauggacaaacucagacuaaaaggagucucauacucccuaugcaccgccgcguucaccuucaccaaaauaccagcagaaacacuccacggaacggucaccgucgaaguacaauaugcaggcacagacggaccgugcaaagucccggcccaaauggcagucgauaugcaaacacuaaccccagucggccgccugaucacugcaaaccccguaaucacagaaagcacagaaaacuccaaaaugaugcucgaauuggacccacccuucggggauagcuacaucguaaucggcgucggcgaaaagaaaauaacacaccacuggcaccgcagugggagcacuauaggcaaagcauucgaagccaccguucgcggagccaaacgcauggccguacucggcgacacagccugggauuucggcucaguaggcggcgcccuaaacucccuagggaaaggcauccaucaaauauucggagcugcguucaaaagccuauucggaggaaugagcugguucucccaaauacucaucggcacacuacugauguggcucggccuaaacaccaaaaacggauccauaagccuaaugugccucgcacucggcggcgugcucaucuuccucagcacagccguaagcgcagac

SEQ ID NO: 2805 - RNA, 2106 nt, Artificial Sequence
  ZIKV prME variant CDS opt
aucauaaacgcacgcaaggaaaagaaacgaagaggcgcugacacaagcgucgggauaguaggccuccugcuaaccaccgcaauggcagcagaagugacucgccguggcagcgcauacuacauguaccucgaccguaacgacgcaggggaagcaauaaguuuccccaccacacucggcaugaacaaaugcuacauccaaaucauggaccucggccacaugugcgacgccaccaugagcuacgagugccccaugcucgacgagggagucgaaccagacgacguagacugcugguguaacacgaccucaaccugggugguauacggaaccugccaccauaagaaaggagaagcccgccgaucccgacgcgcaguaacccuccccucacacuccacccgaaaacuacaaacacgcucacaaacauggcuggaaucacgcgaauacaccaaacaccucaucagaguagagaauuggaucuuccgcaaccccggcuucgccuuagcagccgccgccauagcauggcuacucgggagcucuaccagccaaaaggucauauaccuaguaaugauccugcuaaucgccccagcauacagcauacgcugcaucggcguauccaacagagacuucgucgaagguauguccggcggcacaugggucgacaucguccucgaacacggaggcugcgugaccgucauggcccaagauaaaccaaccgucgacauagaacucgucaccaccacaguaucaaacauggccgagguacgcucauacugcuacgaagcauccauauccgacauggcaagcgacucgaggugcccuacacagggcgaagccuaccuagacaaacaaucagacacacaauacgucuguaaacgcacccuagucgacagaggauggggaaacgggugcggccuauucgggaagggcagccugguaaccugcgcaaaauucgccugcagcaagaaaaugacuggaaaaucgauccaaccugaaaaccuggaauaccgaaucaugcuaagcguccacggaagccagcacucgggcaugaucgucaaugacacaggacacgaaacagacgaaaaucgcgcaaaaguagaaauaacccccaacucgcccagggccgaagccacgcucggcggcuucggaucgcuaggccuugacugcgagcccagaaccggacuagacuucucagaucuguacuaccuaaccaugaacaacaaacacuggcucgugcacaaagaaugguuucacgacauaccccucccauggcacgccggcgcagacacaggcacaccccacuggaacaacaaagaagcacucguagaguucaaagacgcccacgcaaaacgccaaacagucgucgugcuaggcucccaagaaggagccguccacacagcccucgccggcgcccuagaagccgaaauggacggagccaaaggacgacucucaagcgggcaucucaaaugcaggcuaaaaauggauaagcucagacuaaaaggagucagcuacucacuaugcaccgccgccuucaccuucaccaaaauacccgcggaaacacuacacggaacaguaaccgucgaaguccaauacgccggcaccgauggcccgugcaaaguccccgcucaaauggccgucgacaugcaaacauuaacgcccguaggccgccucaucacagcaaauccagucauaacggaaagcacagaaaacagcaaaaugaugcucgaacucgacccgcccuucggagacaguuacaucgucauuggcguaggcgaaaagaaaauaacacaccacuggcacagaagcggaucgaccauaggcaaagcauucgaagcaaccguccgaggcgccaaaagaauggccguacucggagauacagcaugggacuucggaucagucggcggagcccuaaacucccucggcaaagguauacaccaaaucuucggagccgccuucaaaagccucuucggaggcaugucgugguucagucaaauacucauaggaacacuacucauguggcuaggccuaaacaccaaaaacggcucuaucagccucaugugccuagcacuaggaggcguccuaaucuuccucagcacagcgguauccgccgac

SEQ ID NO: 2806 - RNA, 2103 nt, Artificial Sequence
  ZIKV prME variant CDS opt
aucaacgcccggaaagaaaagaaaaggagaggcgcagacacaagcgucggcauagucggacuccuacucacaaccgccauggcggccgaagucacacggagaggaucggccuacuacauguaccuagaccgaaacgacgccggagaagccaucagcuuccccacaacacuaggaaugaacaaaugcuacauacaaauaauggaccuuggccauaugugcgacgccacaaugagcuaugaaugccccaugcucgacgaaggagucgagccggacgacgucgauugcuggugcaacaccacauccacaugggucgucuacggcacaugccaccacaagaaaggagaagccagacgcagcagacgagccguaacacuacccagccacucaacacgcaaacuccaaacccgaagccaaaccuggcucgagagcagagaauauaccaaacaccuaaucagggucgagaacuggauauucaggaacccaggauucgcacuagcugccgcagcaauagcauggcuacuaggcagcagcaccagccagaaagugaucuaccucguaaugauacuucucauagcacccgccuacucaauacgaugcauaggcgucagcaaccgcgacuucgucgaaggcaugucagguggaacauggguagacaucgugcucgaacacggcggcugcgucaccgucauggcccaagacaaacccaccguagacauagagcuagugaccacaacaguaagcaauauggccgaagugagaagcuacuguuacgaagccagcaucagcgacauggcguccgacucucgcugcccaacccaaggagaagcguaccuagacaaacaaagcgacacacaauacguaugcaaaaggacccucgucgaccgaggcuggggcaacggaugcggacuguucggcaaagggagccuaguaacaugcgcaaaauucgcgugcuccaagaaaaugacaggaaaaagcauacaaccagagaaccuagaauaccgcaucaugcuaagcguccacggaagccaacacucaggcaugauaguuaacgacacaggccacgagaccgaugagaaccgcgccaaaguggagaucacaccaaacuccccaagagcagaagcgacccuaggaggauucggaucgcucgggcucgacugcgagccaagaacaggccuagacuucuccgaccucuacuaccuaaccaugaacaauaaacauuggcuagugcacaaagaaugguuccacgacauaccgcucccauggcacgccggcgcugacacgggaacgccccacuggaacaauaaagaagcacuggucgaguucaaggacgcacacgccaaaagacaaaccgucguaguacucggaagccaagaaggcgccguacacaccgcacuggccggagcccuagaagcagaaauggacggcgcgaaaggaagacucagcucaggacaccugaagugccggcucaaaauggacaaacuccgacucaaaggaguaagcuacagccucugcacagccgccuucaccuucaccaagaucccggcagaaacccuucacggcaccgucacaguagaaguacaauacgcagguacagacggacccugcaagguccccgcacaaauggcaguagacaugcaaacccugacaccaguugggagacugaucaccgcaaacccagugaucaccgaaucaaccgaaaacagcaaaaugaugcuagaacucgacccaccauucggggacagcuacauaguaaucggcgugggagaaaagaaaauaacacaccacuggcaccgcucaggcaguacuauaggaaaagccuucgaggccacaguccguggggccaaaagaauggcgguacuaggcgacaccgccugggacuucggcagcguagggggcgcacuaaacucacucggaaaagggauucaccagauuuucggcgcagccuucaaaagccucuucggaggaaugagcugguucagccaaauacucauaggaacgcuacugauguggcugggccucaacaccaaaaacgggucaauaagccucaugugccuagcccuaggcggaguccuaauauuccuauccacagcagucagcgcagac

SEQ ID NO: 2807 - RNA, 2100 nt, Artificial Sequence
  ZIKV prME variant CDS opt
aaugcacgaaaagaaaagaaacgacgaggagcagacacuucagucggcaucgugggccugcuacucacaacagcgauggccgccgaagucacacgccgaggcucugcuuacuacauguaccucgaucgaaacgacgccggggaagcaaucucguuccccaccacgcugggaaugaacaaauguuacauacaaaucauggaccucggccacaugugcgacgccaccauguccuacgaaugcccaaugcucgacgaaggaguagagccagacgacgucgacugcuggugcaacaccaccagcacguggguagucuacgggacgugccaccauaagaaaggagaagcacgcagaaguagacgagcagucacccuaccaagccacucaacccgcaaacuacaaaccagaucucaaacguggcucgaaagucgcgaguacacuaaacaccucauacgcgucgaaaacuggaucuuccgaaaucccggauucgcgcuggcagcagcagccauagccugguuacugggcagcuccaccagccaaaaaguaaucuaccuugugaugauccuacuaaucgcuccagccuacagcauccgaugcauaggcgucagcaaccgagacuucgucgagggcauguccggcggaaccuggguagacaucguacuagaacacggcgggugcgucacagucauggcacaagacaaacccaccgucgacauagagcuaguaaccacgacaguaagcaacauggcagaagucagaagcuacuguuacgaagcaucaauauccgacauggcaagcgacucccgaugccccacccaaggcgaagcauaccuagacaaacaaagcgacacccaguacgucugcaaaaggacccuagucgaccgaggcuggggaaacgggugcggacuguucgggaaaggcagccucguaaccugcgccaaauucgccugcucaaagaaaaugacgggcaaaagcauacaacccgaaaaccucgaauacaggaucaugcuaucuguccauggcagccaacacuccggcaugauagucaaugauacuggacacgaaacagacgaaaaccgcgccaaaguagaaaucacacccaacagcccccgcgcagaagcaacccucggaggcuucggaucccuaggccucgacugcgaaccacgcaccggccucgacuucuccgaucucuacuaccucaccaugaacaauaaacacuggcugguccacaaagaaugguuccacgacauaccccugccguggcacgccggcgccgacacaggaaccccacacuggaacaacaaagaggcgcuagucgaguucaaagacgcccacgcuaaacgacaaacggucgucguccuaggcucccaagaaggggcgguccacacagcccucgcaggagcccuggaagccgaaauggacggcgccaaaggcagacucagcuccggccaccuaaagugccgccucaaaauggacaaacuaagacugaaaggcgucagcuacagccuaugcacagcagcauucacauucaccaaaauacccgccgaaacccugcacggaacagugacaguagaaguccaauacgccggcaccgacgggcccugcaaaguaccagcccaaauggccgucgacaugcaaacgcucaccccagucggccgacugaucaccgccaacccagucaucaccgaauccacagagaacucaaaaaugaugcucgaacuagaucccccauucggcgacuccuacauaguuaucggcguuggagaaaagaaaaucacgcaccacuggcacaggagcgguucaacaauaggaaaagccuucgaagcgacaguccgcggagccaaacgaauggcgguacugggcgacacugcaugggacuucggcagcguaggcggcgcucucaacucccugggaaaaggaauacaucaaauauucggagccgcauuuaaaucacuguucggaggcaugucaugguucagccagauccuaauaggcacccuccucauguggcucggacuaaacacgaaaaauggaagcauaagccuuaugugccuagcacucggcggaguccuaauauuccucagcacggccgugagcgccgac

SEQ ID NO: 2808 - RNA, 2097 nt, Artificial Sequence
  ZIKV prME variant CDS opt
gcccgaaaagaaaaaaaacgacgaggcgccgacacauccguaggaauagucggccuccuacuaaccacggcuauggcagccgaaguaacgcgccgaggaucagccuacuacauguacuuagacagaaacgacgcaggagaagcaaucagcuucccaaccacgcucggaaugaauaaaugcuacauccaaauaauggaccuaggccacaugugugacgccacuauguccuacgaaugccccaugcuagacgagggcgucgagccagacgacgucgauugcuggugcaacaccaccagcaccugggucguguacgggacaugccaccacaaaaaaggcgaagcacgacgaucccgccgagcagucacccugccaucccauagcacaagaaaacuccaaacccgcagccagacauggcuagaaagccgagaauacacaaaacaccucauccgaguggaaaacuggaucuuucgcaacccaggcuucgcacucgcagcagccgccaucgccuggcuccuaggcucgagcaccagccaaaaagucauauaccucgucaugauacuacucauagccccggcauacuccauccgaugcauuggagucagcaaccgggacuucgucgaaggaaugagcggcggcaccuggguagacaucgugcucgaacacggaggcugcguaaccgucauggcgcaggacaaacccacaguagauaucgaacuagucaccacuacaguaagcaacauggcggaaguacgaagcuacuguuacgaggccagcauauccgacauggcaucggacagcagaugccccacccaaggggaggcauaccucgacaaacaaucagacacgcaauacguaugcaaacggacccuggucgaucgcggauggggcaacgggugcggccucuucggcaaaggcucacucgucaccugcgccaaauucgcaugcuccaagaaaaugaccggcaaaagcauacaaccagagaaccuagaauaccgaaucaugcugucaguccacgguagccaacacagcggcaugaucgucaacgacaccggacacgaaaccgacgaaaauagagccaaaguagaaaucacgcccaacagcccaagagcagaagccacccucggcggguucgguagccuaggccuugacugcgagccgcgcacaggacuggacuucagcgaccucuacuaccugaccaugaacaauaaacacuggcucguacacaaagagugguuccacgacaucccccuacccuggcacgcaggagccgacaccggcacgccacauuggaacaacaaagaagcccucgucgaauucaaagacgcgcaugcgaaaagacagacagucguaguccuaggaucacaagaaggagcgguacauacagcacuagcaggagcgcucgaagcagaaauggacggcgcaaaaggacgacuaucgucaggccaccucaaaugccgacucaaaauggacaaacuaagacucaaaggggucagcuacuccuuaugcaccgccgcauucacauucaccaaaauccccgcagaaaccuuacacggaaccgugaccgucgaaguacaauacgcaggaaccgauggacccugcaaagucccagcacagauggccguagauaugcaaacccugacaccggucggccgacuaauaacagcaaaccccguaaucacugaaucaaccgaaaacucaaaaaugaugcuagaacuugacccacccuucggcgacagcuacaucguaaucggcguaggcgagaaaaaaauuacacaccacuggcaccgauccggaagcacgaucggcaaggcauucgaagcgacgguccgaggagccaaacgaauggcaguccucggcgacacagcgugggacuucggcagcgucggcggcgcucucaacagccuaggcaaaggcauccaccagaucuucggcgccgccuucaaaucccuauucggcggcaugucaugguucagccaaauccuaauaggcacacuccucauguggcucggccucaacacaaaaaacggcucaauaagccuaaugugccucgcccucggcggcguucucauuuuccucagcaccgcagucagcgcggac

SEQ ID NO: 2809 - RNA, 2094 nt, Artificial Sequence
  ZIKV prME variant CDS opt
cggaaagaaaagaaacgccgaggcgcagacacgagcguaggaauagucggccuacuccugacgacagcaauggcagcagaaguaacacgccguggaagcgcguacuacauguaccucgaccggaacgacgcaggagaagccaucagcuucccaaccacccucggaaugaacaaaugcuacauacaaauaauggaccuaggacacaugugcgacgccaccauguccuacgagugccccaugcuagacgaaggaguagaaccagacgacguagacugcuggugcaacacaacauccacguggguaguauacggaacaugccaccacaagaaaggcgaagcacgccggagccgacgagccgucacgcugccaucccacagcacacgaaaacuacaaacccggucccagaccuggcuagaaucaagagaauacacaaaacaccucauacggguagagaacuggauauucagaaaccccggguucgcacucgcagccgccgcaauagccuggcuccugggcucaagcaccucccaaaaagugauauaccuagucaugauacugcugaucgccccggccuacuccaucagaugcaucggggucagcaacagagacuucgucgaagguaugucuggaggaaccuggguagacauaguacuagaacacggaggaugcgucacggucauggcucaggacaaacccaccguagauauagaacuggucaccacaacgguaagcaauauggccgaaguaagauccuacugcuacgaggccagcauaucagacauggcauccgacucacgcugcccaacccaaggagaagcauaccucgacaaacaaagcgauacgcaauacgugugcaaaagaacccuaguagaccgaggauggggaaacggcugcggccuguucggcaaagggucacugguaaccugugcgaaauucgcgugcucaaagaaaaugacagggaaauccauccaacccgaaaaccucgaguaccgaauaaugcuaagcguccacgggucacaacacuccggaaugaucgucaacgacacaggacacgaaacagacgaaaacagagcaaaaguagaaaucacaccgaacagcccccgugcugaggcaacacucgggggauucgggucccuaggacucgacugcgaaccacgaacgggacuagacuucagcgaccuauacuaucucacgaugaacaacaaacacuggcuagugcacaaagaaugguuccacgacaucccccuacccuggcacgcaggagccgacacuggcacaccccacuggaacaacaaagaagcacugguagaguucaaagacgcacacgccaagagacagaccguagucguacucggaagccaagagggggcggugcacacagcacucgcaggagcgcucgaagcagagauggacggggccaaaggccgacuauccagcggacaccucaaaugccgacuaaaaauggacaaacucagacuaaaaggagucuccuacagccuaugcacagcagccuucaccuucaccaagauacccgcagaaacacuccacggcaccgucaccgucgaaguacaauacgccgggaccgauggaccaugcaaagucccagcgcaaauggcaguggacaugcaaacccuaaccccagucggacgucugaucaccgcaaaucccgucaucacagaauccaccgaaaauagcaaaaugaugcuggaacuggacccacccuucggcgacaguuacauagucaucggagucggagaaaagaaaauaacacaccauuggcacagguccgggagcaccauaggcaaagcauucgaagcaacaguacgaggagccaaaagaauggccgucuugggagacacugcaugggacuucggcuccguaggaggagcacucaacagccucggaaaaggaauccaccagauauucggcgcagcauucaaaucccucuucggaggcaugagcugguucucccaaauacuuauaggcacgcuccuaauguggcuaggccucaauaccaaaaacggaagcaucucucuaaugugccucgcgcuaggaggcguccuaauauuccuaucaacagcaguuucagcagac

SEQ ID NO: 2810 - RNA, 2091 nt, Artificial Sequence
  ZIKV prME variant CDS opt
aaagaaaagaaacgccgaggggcggacacaagcguggguaucgucggccuacucuuaaccaccgcgauggccgcggaggucacccgacgaggcuccgcguacuacauguacuuagaccgaaaugacgccggcgaagccauaucauuccccaccacgcucggcaugaacaaaugcuacauccaaauaauggaccucggccacaugugcgacgccaccaugaguuaugaaugccccaugcucgacgaagggguagagccagacgacguagacuguuggugcaacacaaccagcacaugggucguguacggaaccugccaccacaagaaaggcgaagcccggcgcagccgccgggcagucacacuccccagccauagcacccgcaaacuacagacccgcucgcaaaccuggcucgaaucaagagaauacaccaaacaccucauccgcgucgaaaacuggauauuucgaaaccccggauucgcccuggcagcagcagcaauagccuggcuucucggcuccagcacaagccagaaagucaucuaccucguaaugauccuauuaauagccccagcuuacuccauccgguguauaggggucuccaacagagacuucgucgaaggcauguccgguggaaccuggguagacaucguacucgaacacggaggaugcgucaccgucauggcccaagacaaacccaccguggacaucgaacucgucacaaccacagucucgaacauggccgaagucagguccuacugcuacgaagcgucaauaucagacauggcauccgacagccgaugcccaacccagggagaagcauaccuugacaaacaaucggacacccaauacgucugcaagcgcacacucguggacagaggauggggcaacggaugcggacuauuuggcaaagggagccuaguaaccugcgccaaauucgcgugcagcaagaaaaugacuggcaaaaguauccaaccagagaacuuagaauaucgaaucaugcucagcguccacggaagccaacacuccggcaugaucgucaacgacacaggccacgagacagacgaaaaccgugccaaaguagaaauaacaccaaauagcccccgagcagaggcaacccucggaggcuucgggagccuaggacucgacugcgagccgaggacgggacuagauuucagcgaccuauacuaccuaacaaugaacaacaaacauuggcuuguccacaaagaaugguuccacgacaucccacuccccuggcacgccggagccgacacuggcacaccucacuggaacaacaaagaagcacucguagaguucaaggacgcccacgcuaaacgccaaacaguuguaguacucggcagccaagaaggagccguccacacagcacucgcaggcgcccucgaagccgaaauggauggagccaagggccgacuaucgucaggacaccucaagugccggcucaagauggacaaacucagacugaaaggaguaagcuacagccuaugcaccgccgccuucaccuucaccaagauccccgcagaaacacuccacggaacagucaccgucgaaguacaguacgccggaaccgacggccccugcaaaguccccgcacaaauggccguggacaugcagacccuaacaccaguaggacgccucauaacagcaaauccaguaauaaccgagucaaccgaaaacagcaaaaugaugcuagaacuagauccacccuucggcgacuccuacauaguaaucggcguaggcgagaagaaaauaacacaucacuggcacagaucagguuccacaaucgggaaagcauucgaagccacaguccgcggagccaaaagaauggcgguacuaggcgacacagccugggacuucggaaguguagguggcgcgcucaacucccuagggaagggaauacaccaaaucuucggcgccgcauucaaaagccuauucggcggaaugagcugguucagccaaauucucauaggcacccuccuaauguggcuuggacucaauacaaagaacgggagcauaucccuaaugugccucgcccuaggcggcguccuaauauuucugagcacagcagucagcgcagac

SEQ ID NO: 2811 - RNA, 2088 nt, Artificial Sequence
  ZIKV prME variant CDS opt
gaaaagaagaggcgaggagccgacaccagcguagggauaguaggccuacuccucacaacagcuauggcagcagaagucacacgacgcggcagugcauacuacauguaccucgaccgaaacgaugccggcgaggccaucagcuuccccaccacacuaggcaugaacaaaugcuacauacaaaucauggaccucggacacaugugcgacgcaacaauguccuacgaaugcccaaugcucgacgaggggguagaacccgacgacguagacugcuggugcaacacgaccuccacaugggugguuuacggcacaugccaccacaagaaaggcgaagcccgacgaagccgacgugcagugacacucccaucgcacuccacacgaaaacuacaaacacgaucucaaacauggcuagaaucccgcgaauacacaaaacaccuaauacggguggaaaacuggauauucagaaaccccggcuucgcccuagcagcagccgcaauagcauggcucuuagggagcuccaccucacaaaaagucaucuaccucguaaugaucuuacuaauagcgccggccuacagcauacgcugcauagggguaagcaaccgagacuucgucgaaggaaugagcggaggcaccuggguagauaucguacuagagcacggcggcugcgucacuguaauggcacaagacaaaccuacaguagacaucgaauugguaacaacaacagucagcaacauggccgaagucagaucauacugcuacgaagcgagcauaagcgacauggcaucugacagccgcugccccacccagggcgaagccuaccucgacaaacagucagacacccaauacguaugcaaaagaacacucguagaccgaggauggggcaauggaugcggacucuucgggaaaggaagccuagucacaugcgccaaauuugcaugcucaaagaaaaugacaggaaaaucgauccaaccagaaaacuuagaauaucgaaucaugcugagcguacacggcagccaacacagcggcaugauagucaacgacacuggacacgaaaccgacgaaaaccgggcaaaagucgaaaucaccccaaacucaccaagggccgaagcaacacucggcggcuuuggaagccuaggccucgacugcgaaccccgcaccggacuagacuucucagaccuauacuaccuaaccaugaacaacaaacacuggcuaguucacaaggaaugguuccacgacauaccccucccauggcacgccggcgcagacacaggaacgccccacuggaacaacaaagaagcacucguagaguucaaggacgcccacgccaagcggcagacaguagucgugcucggaucacaagaaggagccguccacacagcccucgccggagcccuugaagcggaaauggacggcgcaaaaggacggcugucuaguggacaccuaaaaugucggcugaaaauggacaaacugcgucuaaaagguguaagcuacagccuaugcacagcagcguucaccuucaccaaaaucccggcagaaacgcuccacggaaccgucacaguagaaguacaauacgcagggacagacggcccaugcaaaguacccgcccaaauggccguagacaugcaaacacuaacaccagucggaagacucauaacagccaaccccguaaucacagaaagcaccgagaacuccaaaaugaugcuggaacucgauccucccuucggcgacagcuauauagucauaggugucggugagaagaaaauaacacaccacuggcaccgcagcggcagcacaaucggaaaagccuucgaagcaaccguucggggagcgaaacgaauggccgucuuaggcgacacagcaugggacuucggcucuguaggcggagcacugaacagccuaggcaaaggaauccaccagauauucggcgcagccuucaaaucacucuucggcgggaugucuugguucucacaaauacucauaggaacacuccucauguggcuaggcuuaaacaccaaaaacggaucgaucucgcugaugugccuagcacucggcggagugcugauauuccuaucgaccgcaguaucggccgac

SEQ ID NO: 2812 - RNA, 2085 nt, Artificial Sequence
  ZIKV prME variant CDS opt
aagaaacgccgcggcgccgacaccagcguaggaaucgucggacuacuguugacaaccgcaauggccgcggaagugacacgaaggggaagcgccuacuacauguaccucgacagaaacgacgccggagaagccauauccuucccgaccacacuaggcaugaacaaaugcuacauacaaauaauggacuuaggccauaugugcgacgcaacgaugucauacgaaugcccuaugcuagacgaaggaguggaacccgacgacgucgacugcuggugcaacacgacaucgaccuggguagucuacggcacuugccaccacaagaaaggagaagcacgacgaagccgacgggcagucacgcuacccagccacuccacccgaaaacuccaaacucgcagccaaaccuggcucgaaagccgcgaauacaccaagcaccuaauacgagucgaaaacuggauauuccggaacccaggcuucgcccucgcagcagcagcaauagccuggcuccuuggaagcuccacaucccaaaaaguaauauaccuagucaugauacuccuaaucgcccccgcauacagcauccgauguaucggaguauccaaccgcgacuucgucgagggcaugagcggcggcaccuggguagacauaguccucgaacacggaggcugcgucacaguaauggcccaagacaaacccacaguagacaucgagcuggucaccacaacgguaagcaacauggccgaaguccgauccuacugcuacgaagcaagcauaucagacauggcaucagacagcagaugccccacacaaggcgaagccuaccuagacaaacaaagcgacacacaauacguaugcaaacggacguuggucgaccggggcuggggcaacggaugcggucucuucggaaaaggcagccucguaaccugcgccaaauucgcgugcucaaagaaaaugacgggcaaaucaauccaaccggaaaaucuagaguaccggauaaugcuaagcguccacggaucacagcacuccggcaugaucgucaacgacaccggacacgaaacagacgaaaaccgugcaaaaguggagaucacaccaaacagcccccgcgccgaagccacacuaggcggauucggaucccugggacuagacugcgaaccaaggacaggacuagacuucuccgaccucuacuaccucacaaugaauaacaaacacuggcuaguacacaaagaaugguuccacgacaucccacuccccuggcacgccggagcagacacaggcacaccacacuggaacaacaaagaagcacucgucgaguucaaagacgcacaugccaaacgccaaaccgucguagugcuaggaucccaagaaggagcaguccacaccgcgcucgccggagcccuggaagccgaaauggacggagcaaaagggcgccugaguuccggccaccuaaagugccgccuaaagauggacaaacuaagacucaaaggcgucuccuacagccucugcaccgcagcguucaccuucacuaaaaucccggccgaaacacugcacggaacaguaaccguggaggugcaguacgcaggcacagacggacccugcaaagugccggcccaaauggcagucgauaugcaaacacuaacgcccguaggacgacucaucacagccaaccccguaaucacagaguccacagaaaacucaaaaaugaugcuagaacuagaucccccauucggagacagcuacauagucaucggcgucggugaaaagaaaauaacacaccauuggcacagaagcggcucaaccaucggaaaagccuucgaagccacgguccgaggggcaaaacgcauggccguccuaggggacacggcaugggacuucgggagcguagggggagcccucaacucccugggcaagggaauacaccaaauauucggcgccgcuuucaaaagccucuucggcgggaugagcugguucagccaaauccucaucggaacacuucucauguggcucggucuaaacaccaaaaacggaagcauaucgcugaugugccucgcgcuuggcggcguccuuauauuccuaucaaccgccguuuccgccgac

SEQ ID NO: 2813 - RNA, 2082 nt, Artificial Sequence
  ZIKV prME variant CDS opt
aagcgccgcggagccgacacaagcguaggaauugucggccuccuucuuacaacagcgauggcggccgaaguaacccgaagaggcuccgccuacuauauguaccucgacaggaacgacgccggcgaagcaaucucauuccccacaacccugggaaugaacaaaugcuacauccagauuauggaccuaggccacaugugcgaugccaccaugucguacgaaugccccaugcuagacgaaggaguagaaccagacgacguagacugcuggugcaacacaaccagcacaugggucguauacggaacaugccaccacaaaaagggcgaagcgcgaagaagccgccgcgcagugacccucccaagccacagcacacgaaaacuccaaacacgcagccaaacauggcucgaaagccgggaauacaccaaacaccucaucagggucgaaaacuggaucuuccgaaaccccggcuucgcacucgcugcagcagcaauagccuggcuucucggauccagcaccucccaaaaagucauauaccuagucaugauacuccuaauagcccccgcauacucuauacgcugcauaggagugaguaaccgagacuucguggaagggauguccggcggaacaugggucgacaucguccuagaacacgguggcugcguaacaguaauggcacaagacaaacccacaguggacaucgagcuuguaacaaccacaguauccaacauggcagaagucagauccuacugcuacgaagccuccauaucugacauggccucagacucacgaugcccaacccaaggagaagcauaccuagacaaacaaagcgacacacaauauguaugcaaaagaacauuagucgaccgcggauggggaaacggaugcggacuuuucggaaaagguucccuagugacuugcgccaaauucgccuguucgaagaaaaugaccggcaaguccauccaaccggaaaaccuggaauaccgaaucaugcuaucuguccacggcucgcaacacucaggcaugaucguaaacgacacgggccacgaaacagacgaaaacagagccaaagucgagauaacccccaacuccccucgcgccgaagccacgcucggcggauucggaagccugggccucgacugugaaccgcgaacaggacuagacuucagcgaccucuacuaccuaaccaugaacaacaagcacuggcuaguccacaaagaaugguuccacgacaucccacucccauggcacgcaggagccgacaccggaacaccacacuggaacaacaaggaagcccucgucgaguucaaagacgcgcacgccaaacgccaaacaguggucguccuaggaucccaagaaggcgccguccacaccgcacuagcgggagcccucgaagccgaaauggacggcgcaaaaggaagacucagcucgggccaccuaaaaugcagacuaaaaauggauaagcuccgacugaaaggaguaucuuacucccuaugcacagcagcauucaccuuuacuaaaauccccgcagaaacacugcacggaacaguaaccgucgagguacaauacgcaggcaccgacggacccugcaaaguaccggcccaaauggccgucgacaugcaaacccucacaccagucggaagacucaucacggcaaaccccguaaucaccgaauccaccgaaaacucuaaaaugaugcuggagcuagacccacccuucggcgacagcuacaucgucaucggagugggagagaagaagaucacccaccacuggcaccgaagcggcagcaccaucggcaaagcauucgaggcgacuguccgcggagcgaaaagaauggccguucucggggacaccgcaugggacuucggguccgucggcggcgccuuaaacagucucggaaaaggcauacaccaaauauucggcgccgcguucaaaagccuguucggaggcauguccugguucucgcaaauacuaaucggcacccuccuuauguggcucgggcuaaacaccaaaaacggaagcauaagccuaaugugccuagcccuaggcggcgugcucaucuuccuuagcacagccguaagcgcggac

SEQ ID NO: 2814 - RNA, 2079 nt, Artificial Sequence
  ZIKV prME variant CDS opt
agacggggcgcagacacaagcgucggaaucgucggacuccuacuuacgaccgcaauggcggcugaagucacacgccgaggauccgcauacuacauguaccucgaccguaacgacgcaggcgaagccauaucauucccuacaacgcugggaaugaacaaaugcuacauccagauaauggaccuaggccacaugugcgacgcaaccauguccuacgaaugcccaaugcucgacgaaggggucgaacccgacgacguagacugcuggugcaacacaacgagcacauggguaguguacggaacaugccaccacaaaaagggggaagcccgacgauccaggagagcagugacacucccaagccacagcacaagaaaacuacagacaagaucacaaaccuggcuugaaagcagagaauacacaaagcaccuaauacgaguugaaaacuggauauucagaaaccccggcuucgcacucgcagcagccgccauagccuggcuccugggcaguucaacgagccaaaaagucauauaccuaguaaugauacugcuaaucgccccagcauacucaauacgcugcaucggcguauccaaccgagacuucguagaaggaaugucaggaggaaccuggguagacauuguacucgaacacggaggaugcguaacagucauggcccaggacaaacccacggucgacaucgaacucguaacaacaaccguaucaaacauggcagaaguacgauccuacugcuacgaagcaagcaucucugacauggccucagacucacgaugccccacccagggcgaagccuaccuagacaaacagucggacacacaauacgucugcaaacgaacacuggucgaccgcgguuggggcaacggcugcggccuguucggaaaagggagccuagugaccugcgccaaauucgccugcagcaagaaaaugaccggcaaaucgauacaacccgaaaaccuugaguacagaaucaugcuauccguccacggcagccaacauuccggcaugauagucaacgacaccggccacgaaacagacgaaaacagagcaaaagucgaaaucacgcccaacuccccacgggcggaagccacacugggaggauucggcagccucggccuagauugcgaaccacgcacaggguuagacuucuccgaccucuacuaccuuacaaugaacaacaaacauuggcucgugcacaaagaaugguuccaugacaucccacuccccuggcaugcaggcgccgacacggggacaccacacuggaauaacaaggaggcgcuuguggaguucaaggaugcgcacgccaaacgacaaacaguaguuguccuaggcucacaagaaggcgcgguccacacagcccucgccggggcacuagaagccgaaauggacggcgccaaagggcgacucagcagcggccaccucaaaugccgacuaaaaauggacaaacugcgccuaaaaggggucagcuacagccucugcaccgccgcauucaccuucacaaaaauaccagccgaaacccuacacggcacagucacaguagaaguacaauacgccggcacagacggacccugcaaagucccagcccaaauggcggucgacaugcaaacccucacgccaguaggccgacuaaucacagcaaacccagucaucaccgagagcacagaaaacagcaaaaugaugcuagaacuggacccgccauuuggagauaguuacaucguaauuggcgugggggaaaagaaaauaacacaccacuggcacagaagcggcuccacaaucggaaaagcauucgaagcuaccguccgaggagcgaaacgaauggccguacucggcgacacagccugggacuucggcucaguaggcggagcccugaacucccucggcaaaggaauacaccaaaucuucggggccgcguucaaaucccuguucggaggaaugagcugguucucacagauacucauaggcacacuacuaauguggcuaggccuaaacacaaagaacggcagcauuagcuugaugugccuagccuugggaggcguacuaauauuccuaagcacagccguaucagccgac

SEQ ID NO: 2815 - RNA, 2076 nt, Artificial Sequence
  ZIKV prME variant CDS opt
cgaggagccgauacuucggucggcauagucggccuacuccuaaccacggccauggcugcagaagucacaagacggggcucagccuacuacauguaccucgacagaaacgaugcaggagaagcaaucucguuccccacaacacugggcaugaacaaaugcuauauacaaaucauggaucuuggccacaugugcgacgcaaccaugagcuacgagugcccaaugcucgacgaaggcgucgaacccgaugacguggacugcuggugcaacacaaccagcacaugggucguauacggaaccugccaccacaagaaaggcgaagcccgccgaucacggcgcgcagugacccuccccucacacuccacccgaaaacuacaaacaagaagccaaaccuggcucgaaucacgcgaguacaccaaacaccuaaucagaguagaaaacuggauauuccgcaacccaggcuucgcacuggccgccgcggcaauagcauggcuccuuggcucaagcacaucacaaaaaguaauuuaccucguaaugauacuacucaucgcccccgccuauagcauccgcugcaucggcgucucaaaucgcgacuucguagaaggcaugagcggcggaacauggguagacaucguccucgaacacggagguugcgucacggucauggcccaagacaaacccacaguagacaucgagcuagucaccacgacagucucuaacauggcugaaguacgaagcuauugcuacgaagcgaguaucuccgacauggcaucagacucacguugccccacccaaggagaggccuaccucgacaaacaauccgacacacaauacgucugcaaacgcacccucguagacagaggaugggggaacggcugcggacuguucggcaaaggaagccucguaacaugcgcaaaauucgcaugcucaaagaaaaugaccggaaaaucaauacaaccagaaaaccucgaauaccgcauaaugcuauccguacacggcucccaacacuccggaaugauaguaaacgacaccggccacgaaaccgacgagaaccgagcaaaagucgagaucaccccuaacuccccacgcgcagaagcaacccuaggcggcuucggcucccucggacuggacugcgaacccagaaccggacuggacuucucagaccucuacuaccucacaaugaacaacaaacacuggcucguucacaaggagugguuccacgacaucccccuccccuggcacgcaggcgcggacacagguacgccacacuggaacaauaaggaggcacucgucgaguucaaagacgcacacgcaaaacgccaaacugucgucguacugggcucccaagaaggagccguacacacagcccucgccggggcacucgaagccgaaauggacggcgccaagggacgacuaagcuccggccaccucaaaugccgacuaaaaauggacaagcuacggcucaaaggcgucucguacagccucugcacagcggccuucaccuucaccaaaauccccgccgaaacucuacacggcacagucaccguagaaguccaguacgcaggaaccgacggccccugcaaggugccagcacaaauggccguagauaugcaaacccuuacccccguaggccgccucauuaccgccaaccccgugauaaccgagagcaccgaaaacagcaaaaugaugcuagaacucgaucccccauucggcgacaguuacaucgucaucggcgucggagagaagaaaaucacacaccacuggcacagauccgguucaacaauaggaaaagccuucgaagcaaccguccgcggagccaaacgcauggcaguacucggcgacaccgcaugggacuucggauccgucggaggagcccuaaacucccucggcaagggaauacaccaaaucuucggcgccgccuucaaaagccucuucgguggaaugucaugguucagccaaauccugaucgggacacuucuaauguggcuuggccuaaacaccaaaaacggcagcaucagucucaugugucuagcccucggcggaguacucauauuccuaucaacagcaguauccgccgac

SEQ ID NO: 2816 - RNA, 2073 nt, Artificial Sequence
  ZIKV prME variant CDS opt
ggggcggauaccuccguaggaauagucggacuacuacucacuaccgcaauggccgcagagguaacacgacgcggcagcgccuacuacauguaccuagaccgaaacgacgcaggagaagcaaucagcuuccccacgacacugggaaugaacaagugcuacauacagaucauggaccucggccacaugugcgacgcaaccaugagcuacgaaugcccaaugcuagacgaaggaguagaacccgacgacguagacuguugguguaacaccacaagcaccugggucgucuacggaacaugccaccacaagaagggagaggcccgccgcagcagacgagccguaacacuacccucgcacagcaccagaaaacuacagaccagaagccaaacauggcuagaaagcagagaauacacaaaacaccuaauccggguagaaaacuggauauuuaggaacccgggauucgcacuagcagccgcagcaauagcauggcuacuagggagcucaaccucccaaaaaguaauauaccuagucaugauccuacucaucgcgccagcauacuccauccggugcauaggaguaucaaacagagauuucguagaaggcaugucagggggcaccuggguagacauaguccucgaacacggagggugcguaacggugauggcacaagauaaaccaaccguagacaucgagcuaguaacaacaacagucagcaacauggccgaaguaaggucguacugcuacgaagccaguaucucagacauggccagcgacucacgaugcccaacccaaggagaagccuaccuagacaaacaguccgacacacaguacguaugcaaacgcacgcucgucgaccgaggcuggggaaacggcugcggccuguucggaaaagggagccuggucacaugcgcaaaauucgccugcuccaagaaaaugaccggaaaauccauacaacccgaaaaccuagaauaccggaucaugcucaguguccacggcagucagcauagcggcaugaucguaaacgacaccggacacgaaacagaugaaaaccgagcaaaagucgaaauaaccccaaacucgccccgagcagaagccacauuaggcggcuucggaucccuaggacuagacugcgaaccccgaaccggacucgacuucucagaccuguauuaucucacgaugaacaacaaacacuggcugguacacaaggaaugguuccacgacauaccacuaccauggcacgcuggagcugacaccggaacaccacacuggaacaacaaagaggcccuaguagaguucaaagaugcacaugccaaacgccaaaccgugguaguccuagggucccaagaaggagccgugcacaccgcacucgccggcgcacuggaagcagaaauggacggagccaaagggcgacuaagcuccggccaccuaaaaugcagacucaaaauggacaaauuacgacuuaaaggcguaagcuauucacugugcacggcggcauucacauucaccaaaauacccgccgaaacccuacacggaacagucaccguagaaguccaauacgccgggacagacggaccgugcaaagucccagcccaaauggccguagacaugcaaacacucacccccguaggaagacucauaaccgcaaacccggucaucaccgaaucaaccgaaaacagcaaaaugaugcucgaacuagacccgcccuucggggacagcuauauagugauaggcguaggagaaaagaaaauaacgcaccacuggcaccgaagcggcagcacaauagggaaagccuucgaagccacaguacgaggagcgaaaagaauggcaguccugggagacaccgcgugggacuucggaucgguaggaggcgcacuaaacagccugggaaaaggaauacaccaaaucuucggcgccgccuucaaaucacucuucggcggaaugucaugguucucccagauacuaaucgggacccuccugauguggcuaggucuaaacaccaaaaauggcucaaucucacuaaugugccuagcgcuaggaggcguccucaucuuccuguccacagccguaucggccgac

SEQ ID NO: 2817 - RNA, 2070 nt, Artificial Sequence
  ZIKV prME variant CDS opt
gcagacaccaguguaggcaucguaggacuccuacuaaccacagcaauggccgcugaagucacacgacgcggaagcgcauacuacauguaccuagaccguaacgacgccggcgaagcaaucucguuccccacgacccucggaaugaacaaaugcuacauucaaauuauggaccuagggcacaugugcgacgcgacaaugagcuacgaaugccccaugcucgacgaaggcguggaaccagacgacgucgacugcuggugcaacacaacaagcacauggguggucuauggaaccugccaucacaagaaaggcgaagcacgaagaagccgccgggcaguaacacuuccgagucacagcacccgaaaacuccaaacacgcagccaaacauggcuagaaagccgcgaauauacgaaacaccuaaucagaguagaaaacuggauauuccgaaacccuggcuuugcacucgccgcagcagccauagcauggcuccugggcagcagcacaagccaaaaagucaucuaccuagucaugauacuccuuaucgcccccgcauacucaauccgcugcaucggcgucucgaacagggacuucguggagggcaugagugggggaaccuggguagacaucguccuagaacacggcggcugcgucacgguaauggcacaggacaaaccaacaguagauauagagcuaguaaccacuacaguauccaacauggcagaaguccgcagcuacugcuacgaagcaucgauaucggacauggccagcgauuccagaugcccaacccaaggggaggccuaccucgacaaacaaagcgacacccaguacguaugcaaaagaacacucguggacagaggguggggcaacggcugcggacuauucggcaagggaucacugguaaccugcgccaaauucgccugcuccaagaaaaugaccggcaaaagcauacagccagaaaaccuagaauacagaaucaugcucuccguacacggcucgcaacacagcggaaugaucguaaacgacacaggacacgaaacagacgaaaaccgcgcaaaagucgaaaucaccccgaacuccccgcgcgcagaagcaacacuaggcggcuucggaagccucggacuagacugcgaaccucgaaccggccucgacuucagugaccucuacuaccucacaaugaacaacaaacacuggcuaguacacaaagaaugguuccacgacaucccccuacccuggcacgcgggcgcagacacaggcacaccacacuggaacaacaaagaagcccugguggaguucaaggacgcccacgcaaaacgacaaaccgucgucguacuugggagucaagaaggcgcaguacacacagcacucgccggagcacucgaagccgaaauggacggugccaaaggacgccugagcagcggccaccucaagugcagacuaaagauggacaaacuaagacucaaaggagugagcuacagccuuugcaccgcagccuucaccuucacaaaaauaccggccgaaacccugcacggaacggucaccguagaaguccaguacgccggaacugacggacccugcaaggucccagcacaaauggcgguagacaugcaaacccuaacaccaguagggagauuaauaaccgccaaccccguaaucacagaaagcacggaaaacagcaagaugaugcuagaacucgacccgcccuucggggacagcuacauaguaauaggagucggagaaaagaagaucacccaccacuggcaccgaagcgggagcaccaucgguaaagcguucgaagcaacaguacgcggcgccaaacgcauggccguacucggugacaccgccugggacuucggcucggucggcggggcccucaauagccuuggcaaaggcauucaccaaaucuucggcgccgcauucaaaagccuauucggcggaaugagcugguucagccagauacucauagguacacuucuaauguggcucgggcucaacaccaaaaacggcucaaucagccuaaugugccuggcccucggaggagugcuaaucuuccuaagcacagccgucagcgccgac

SEQ ID NO: 2818 - RNA, 2067 nt, Artificial Sequence
  ZIKV prME variant CDS opt
gacacaagcgucggcaucguaggacuacuacucacaacagccauggcagcugaagucaccagacgcggcuccgcauacuacauguacuuagaccgcaacgacgccggcgaagccaucucauucccaacaacacugggaaugaacaaaugcuacauccaaaucauggaccucggacacaugugcgacgcaacgaugucauaugagugcccuaugcuggacgaaggagucgaaccagacgacguagacugcuggugcaacaccacgagcacgugggucguauacggcacuugccaccacaagaaaggggaagcccgccgcucacgccgagccguaacccuaccaucccacucaacccggaaacuacaaacacgcucccaaacauggcuagaaagcagagaguacacaaaacaccugauacgcgucgaaaacuggauauuccgaaaccccggauucgcccucgccgcugccgccauagccuggcuccugggcagcuccaccucacagaaagucaucuaucucguaaugauccuacucaucgcccccgcauacagcauacgaugcauaggcgucucaaaccgcgacuucgucgaaggaauguccggaggcaccuggguugauaucguccuagaacacgguggaugcguaaccgucauggcacaagauaaacccaccgucgacaucgaacucguaacaaccacagucucgaacauggccgaaguacgauccuacugcuacgaagccagcaucucggacauggccuccgacagccgcugccccacccaaggcgaagcauaccucgacaaacaaagcgacacucaauacguaugcaagcggacacuuguagaccgaggcugggggaacggcugcggacucuucggcaaaggcagccuuguaacgugcgcaaaguucgccugcucaaagaaaaugaccggaaaauccauacaacccgaaaaccuugaauaccgaauaaugcuaagcguccacggaucgcaacauuccggaaugaucgucaacgauaccggccacgaaaccgacgaaaaccgagcaaaagucgaaaucacacccaacagcccccgcgcagaagccacccuagggggcuucggaagccucggacuagacugcgaaccgcgcacaggccucgacuucagcgaccuguacuaccucaccaugaacaauaaacacuggcuaguccauaaagagugguuccacgauauccccuuaccauggcacgcaggagcagacaccggcaccccacacuggaacaacaaagaggcacucgucgaguucaaagacgcacacgccaaacgccaaaccgucgucguacucggcucacaagaaggcgccguccauacagcccuggcgggagcccuagaagcagaaauggacggagccaaaggcagacuaagcucgggccaccucaaaugccgccuaaaaauggacaaacucagacucaaaggaguaagcuacucuuuaugcaccgccgcguucacauucacaaaaauucccgcagaaacccuccacggaacaguaaccguagaaguacaauacgccggcaccgacggccccugcaaagucccggcccagauggccguugacaugcaaacccuaacacccgucggcagacuaauaaccgccaacccaguaaucaccgaauccacggaaaacucaaaaaugauguuagagcuagauccaccguucggagacagcuacaucgugaucggcgucggcgaaaagaaaauaacccaccacuggcaccgcagcggaagcaccauaggcaaagccuucgaagccaccguccgaggggcgaaacgcauggcgguccuaggagacacagcuugggacuucggcagcguaggcggagcgcuaaacucacucggcaaaggcauccaccaaaucuucggcgcggcauucaaaucguuguucggaggaaugucaugguucucacagauacucaucggcacacuccugauguggcuaggccucaacaccaaaaauggcucaauaagccuaaugugccuagcacucggcggcguccuaaucuuccugagcacagccgucagcgcugac

SEQ ID NO: 2819 - RNA, 2064 nt, Artificial Sequence
  ZIKV prME variant CDS opt
acaagcguaggaauugucggacuccuacuaacaaccgcgauggcagcagaaguaacgcgacgcggcucagccuacuacauguaccuagaccgaaacgacgccggagaagccaucucauucccgaccacacucgggaugaauaaauguuacauacaaauuauggaccuaggccacaugugcgacgcaaccaugucguacgaaugcccgaugcucgacgagggagucgaaccggacgacguagacugcuggugcaacaccacguccacaugggucgucuacgggaccugccaccacaagaaaggagaagcacgacgaagccgacgggcgguuacccuaccaagccacagcacacgcaaacuccaaacacgcagucaaaccuggcucgaaucccgagaauacaccaaacaccuaauacgcgucgagaacuggaucuucaggaauccaggauucgcccucgcagcagcagccaucgcauggcuccugggcucgagcacuagccaaaaaguaauauacuuaguaaugauccuacugaucgcccccgcauacucaauacgaugcaucggcguaagcaaccgcgacuucgucgaaggcaugucaggaggaacauggguagacauaguccucgaacacgggggcugcgucacgguaauggcacaggacaaaccaacagucgacauagagcuagugaccaccacagucaguaacauggcggaaguccgaucguacugcuacgaagccagcauaucagacauggccucagacucacgcugccccacacagggagaggccuaccucgacaagcaaagcgacacacaauaugucugcaaaagaacauuagucgaucgcggguggggcaacgggugcggccucuucggcaaaggcagucucguaacaugcgcaaaauuugcaugcuccaagaaaaugacaggaaaauccauacaacccgaaaaucucgaguacagaaucaugcuauccguccacggcucccaacauagcgggaugauagugaacgacacgggccacgaaacagacgaaaaccgagccaaagucgaaauaacacccaacaguccccgcgcagaagcaacacuaggcggguucggcagccuaggcuuagacugcgaaccacgcacaggcuuagacuucagcgaccuauacuaccucaccaugaacaacaaacacuggcugguccacaaagagugguuccacgacaucccacuccccuggcaugcaggagcugacacgggcaccccacacuggaacaacaaagaggcucucguagaguucaaagacgcacacgcaaaacgacaaacagucgugguccuaggcucacaagaaggagcgguacauaccgcacuagccggagcccucgaggccgaaauggacggagcgaaggggcgccuaagcucaggacaccuaaagugccgacuuaaaauggacaaacuacgauugaaaggagucuccuacucccucugcacagcagccuuuacauuuaccaaaauaccggccgagacccugcacgggacuguaacaguugagguacaauacgccgggaccgacggcccaugcaaaguaccagcccaaauggcaguagacaugcagacccuaacccccguagggcgccugauaaccgccaauccagucaucacagaaucaacggaaaacucaaaaaugaugcuagaacuagaucccccauucggcgacagcuacauagucauaggagucggagaaaagaaaauaacccaccacuggcacaggucaggcucaacaaucggaaaagcauucgaagccacgguacgaggcgcgaaaagaauggcgguccucggcgacacugcaugggacuucggauccguaggcggcgcccucaacucacucggaaaaggaauccaccaaaucuucggcgccgcauucaaaucacuguucggcgggauguccugguucagccaaauacucaucggaacgcuacuaauguggcuaggccuaaacaccaagaacgggagcaucucccugaugugccucgcccuaggaggaguacugauauuccugagcacagccguaagcgccgac

SEQ ID NO: 2820 - RNA, 2064 nt, Artificial Sequence
  ZIKV prME variant CDS opt
accuccgucggcaucguaggacuccuccuaacaaccgccauggcagccgcaguuacacgacgaggaagcgccuacuacauguaccuagacagaaacgacgccggagaagccauauccuucccgacgaccuuaggcaugaacaaaugcuacauacaaauaauggaccuaggacacaugugcgacgcaacgaugucauaugaaugccccaugcucgacgaaggaguggaaccugacgacguagacugcuggugcaacacgacaucaaccuggguaguauacggaaccugccaccacaagaaaggcgaagcccgacguucccggcgagccguaacccuccccagccacuccacacgcaaacuacagacacgaucacaaaccuggcuagagucacgagaauacacaaaacaccugauacgcguagagaacuggaucuuccgcaaccccggauucgcacuagccgccgcugccaucgcauggcuacuaggcagcucgaccucacaaaaaguaauauaccucguaaugauccuccuaaucgccccagccuacuccauacgcugcaucggggucucaaaccgcgacuuugucgaaggcauguccggaggaaccugggucgacauaguacucgaacacggcggcuguguaaccguaauggcacaagacaagccuacaguagacaucgagcuagucacaacaacaguaucaaacauggccgaaguacgcuccuacugcuacgaagcaagcauaagcgacauggcaagcgacagccggugccccacacaaggcgaagccuaucuugacaaacagagcgacacacaauacgucugcaaaaggacccucguagacagaggcuggggcaacggcugcggacuauucggaaaagggucacucgucacaugcgcaaaauucgccugcaguaagaagaugaccgggaaaagcauccaacccgaaaaccuagaauaccguaucaugcucagcguacacggcucacaacacuccggcaugauugucaaugacaccggucacgaaacagacgagaaccgcgcaaaaguggaaauaacccccaacucgcccagggccgaagcgacacucggaggauucggaucccuuggccuagacugcgaacccaggacaggacucgacuucucagaccucuacuaccuuaccaugaacaacaaacacuggcucguacacaaagaaugguuucacgacaucccccuaccauggcacgcgggagccgacacaggcacaccacacuggaacaacaaagaagcccuagucgaauuuaaggacgcacacgcaaaaagacaaaccguaguuguccuaggaucacaagaaggcgcaguacacacggcccucgccggagcccucgaagccgaaauggacggcgccaaaggccgacuaagcagcggccaccucaaaugccgccugaaaauggacaaacuccgacuaaaaggugucaguuauucccuaugcacagccgccuuuaccuucacaaaaauacccgcagaaacccuccacggcaccgucaccgucgagguccaauacgccggcacggacggccccugcaagguacccgcacaaauggccguggacaugcaaacccugacccccgugggcagacucauaacagcaaacccagucauaacagaaagcacagaaaacuccaaaaugaugcucgaacuagacccgcccuucggggacucauacauaguaauaggcguaggagagaagaaaaucacccaccacuggcaccgaucgggaucuaccaucggcaaagcauucgaagccaccgugcgaggcgccaaacgaauggcaguccucggcgacaccgcaugggacuuuggcucugucggaggagcccuaaacagccucggcaaaggcauccaccaaaucuucggugcagcguucaaaagccucuucggcggcauguccugguucagccaaauccugaucgggacccuacucauguggcuaggccucaauaccaaaaacggauccaucagccuaaugugccuggcccuaggcggaguccugaucuuccucucaacagcagucagcgcagac

SEQ ID NO: 2821 - RNA, 2076 nt, Artificial Sequence
  ZIKV prME variant CDS opt
cgaggcgcggacacgucagucggcauagucggucuacuacuuacaaccgccauggcagccgccguuacacgccggggauccgccuacuacauguaccucgaccgcaacgacgccggcgaagcaaucucguucccaaccacacuaggcaugaacaaaugcuacauccaaauuauggaccuaggacacaugugcgacgccaccaugagcuacgagugcccaaugcuagacgaaggaguggagccagacgacguggacugcuggugcaacacuacaucgaccugggucgucuacgggaccugccaccacaagaaaggagaagcacgaaggucaagacgagcuguaacacuaccaagccacuccacaaggaaauuacagacccgaagccaaacauggcucgaauccagggaauacaccaaacaucucauucgcguagaaaacuggauauuccgcaacccaggcuucgcacuagcggcggccgcgauagcuuggcuccucgggagcuccaccucgcaaaaaguaaucuaccuagucaugauccuacucauagcucccgcguacagcaucagaugcaucggcguaagcaaccgcgacuucgucgaaggcaugagcggcggcaccuggguagacauaguacucgaacacgggggcugugucaccguaauggcacaagacaaaccaacgguggauaucgagcuagucacaacgaccgucuccaacauggccgaaguaagaagcuauugcuacgaggcauccauaagcgacauggcaagcgacucgcgcugcccaacgcaaggugaagcauaccuagacaaacaaagcgacacacaauacguaugcaaacgcacccucgucgacagaggguggggcaauggaugcggacucuucggcaaaggcucccucgucacaugcgcaaaauucgccugcuccaaaaagaugacaggcaaaucaauccaacccgaaaaccuagaguaccgaauaaugcucagcguccacggaagccaacacagcggaaugauagucaacgacacaggacacgaaaccgacgaaaaccgcgcaaaagucgaaaucacaccaaacaguccaagagcggaagcaacacuaggcggauucggaucacuaggacuagauugcgagccacgcacaggacuagacuucagcgaccuauacuaccugacgaugaacaacaaacacuggcucguacacaaagagugguuccacgacaucccccucccauggcacgccggcgccgacaccggcaccccgcauuggaacaacaaagaagcccuaguagaguucaaagacgcacacgcaaagcgccaaaccgucgucguacuaggaagccaagaaggagcgguccacacagcccuagccggcgcccuagaagcugaaauggacggagcaaaaggaagacuaagcagcggucaccucaaaugcagacucaaaauggacaaacuacgccucaaaggcguaucguacucccucugcaccgccgccuucacauucaccaaaauaccagcagagacacuacacggaaccgugacaguggaaguccaauacgccggcaccgauggaccaugcaaaguacccgcacaaauggcaguagacaugcaaacccugacacccgucggcagacuaaucacagccaacccagucauaaccgaaagcaccgagaacagcaagaugaugcucgagcucgacccgccauucggggacagcuacaucgucauaggagugggagaaaagaaaaucacccaccacuggcaccgaagcggcucaacaauaggaaaagcguucgaagcgaccguccgaggagccaaacgcauggcaguacucggugacacagccugggacuucggcucaguaggcggcgcccuaaacucucuaggaaaaggcauacaccaaaucuuuggcgcagccuucaaaucacucuucggcggcaugagcugguucucccagauccuaauaggcacacuacuaauguggcucggacucaacaccaaaaauggcucgaucagccugaugugccucgcacuaggcggcguacugaucuuccuauccacagcgguaagcgccgac

SEQ ID NO: 2822 - RNA, 2100 nt, Artificial Sequence
  ZIKV prME variant CDS opt
cgcggccuaucgucacggaaaagacggagccacgacgugcuaacagugcaauuccucauacucggcaugcuacuaaugaccggaggcgucacccgccgaggcucagccuacuacauguaccuagacaggaacgacgccggggaagccauaaguuuccccacgacacugggcaugaacaaaugcuauauacaaaucauggaucuaggccacaugugcgacgccaccaugagcuacgaaugcccgaugcuagacgaaggagucgagccagacgacguggacuguuggugcaacacaacauccacauggguagucuacggaacaugccaccauaagaaaggagaagcccgacgcucaaggagagccgugacccucccaagccacucgaccagaaaacuccaaacaagaagccaaacguggcucgaaucgagggaauacacgaagcaccuaauaagagucgaaaacuggauauuccgaaacccaggauucgcacuggccgcggccgccaucgccuggcuacucggaagcagcacgagccaaaaaguaauuuaucuuguaaugaucuugcugauagccccggccuacagcauccgaugcaucggcguuucgaauagagacuucguagaaggcaugagcggcgguaccuggguagauaucguccucgaacacgggggaugcgugaccguaauggcccaggacaaaccgaccgucgacauagagcuaguaaccacaacagucagcaacauggcagaagucaggaguuacugcuaugaagcaucaauaucagacauggcaagcgacagcagaugcccuacacaaggggaggcauaccucgacaaacaaagugacacccaauacgucuguaaaagaacccuagucgaccgcggaugggggaauggcugcggacuauucggaaaagggagccuagugacaugcgccaaauucgcaugcucaaagaaaaugacaggaaaaagcauccaaccagaaaaccucgaguacagaauaaugcucagcguccacgggucacagcacagcggcaugauaguaaacgacaccggacacgaaaccgacgaaaaccgagccaaaguagaaauaaccccuaauagccccagagcugaggcaacccuaggaggcuucggcagcuugggacucgacugcgaaccccgaacgggacucgacuucuccgaccuauacuaccucaccaugaacaacaaacacuggcucgugcacaaagaaugguuccacgacaucccccugcccuggcacgccggcgccgacacaggaacgccucacuggaacaacaaggaagcccuuguagaguucaaagacgcgcacgcaaaacgccaaacgguggucgugcucggaagucaagaaggagccgugcacacggcacuagccggcgcgcucgaagccgaaauggacggagcaaaggggcgacugagcagcggacaccugaaaugccggcugaaaauggacaaacugagacuaaaaggagucagcuacagccuaugcaccgccgcauucacauucacaaaaauaccggccgaaacacuacacgguacagucacgguagaaguccaauacgcggggacagacggacccugcaaagucccagcgcaaauggcgguagauaugcagacacucacacccguggguagauuaauaacagcaaaccccgucaucacagaaagcacggaaaacagcaaaaugaugcuagaacuagacccacccuucggagauucauacauagucauaggcguaggcgaaaagaaaauaacccaccacuggcaccgcagcggcagcacaaucggaaaagcauucgaagcaacggugaggggagccaaacgaauggcgguccucggagauacagccugggacuucggaagugucgggggugcacugaacagccuaggcaaaggcauacaccaaaucuucggagcagcguucaaaagccucuucgggggaaugagcugguucucccaaauauugauaggaacucuacucauguggcucgggcuaaacacuaaaaauggcagcaucagccucaugugccuggcccucggaggcguccucauauuccuaagcacagccgucagcgccgac

SEQ ID NO: 2823 - RNA, 2100 nt, Artificial Sequence
  ZIKV prME variant CDS opt
cgaggccuuagcucccgcaaacgacgcagccacgacguacuaaccguccaauuccuaauacuaggcaugcuccucaugacaggcgccguaacaagacgggguuccgcauacuacauguaccucgacaggaacgacgcgggagaagccauuuccuucccaaccacacucggcaugaacaaaugcuacauacaaauaauggaucucggacacaugugcgacgccaccaugucauacgaaugcccaaugcuagacgaaggaguggaacccgacgacguagacugcuggugcaacaccacauccaccuggguagucuacggaacgugccaccacaagaaaggagaagcacggcgaagccgacgagccguaacccuccccucccacagcacucgcaaacuccaaacacgaucacaaacauggcuagaaucccgcgaauacaccaaacaccuaauacgcgucgaaaacuggaucuuucgaaacccaggcuucgcccucgcagcagccgcgauagcauggcuucuuggaagcagcacaagucaaaaaguaaucuacuuaguaaugauccugcuuauagcgccugcauauucgauacggugcaucgggguaagcaaccgcgacuucgucgaaggaaugucaggaggcaccuggguagacauuguacucgaacacggaggaugcguaaccguaauggcccaagacaaaccuacagucgacauagagcucguaacgaccacaguaagcaacauggcagagguccgaucauacugcuacgaagccucaauaagugacauggccucagacucacgcugcccaacccaaggcgaggccuaccuagacaagcaauccgacacacaguacgucugcaaacgcacacucgucgacagaggguggggcaacgguugcggccuuuucggcaaaggaucacucguaacaugcgcaaaauucgccugcuccaagaaaaugacuggaaaaagcauacaaccagaaaaccuagaguacagaauaaugcuauccguacacgggagccagcacucaggaaugaucgucaacgacacgggacacgaaaccgacgaaaaccgcgcaaaaguagaaauaacacccaacucaccccgagcagaagcgacccuaggaggauucggaucccucggacuagacugugaacccagaacaggccucgacuucagcgaccucuacuaccucaccaugaacaacaaacacuggcuuguccacaaagagugguuccacgacaucccccuacccuggcacgccggagcagacaccggcaccccacacuggaacaacaaagaagcccucgucgaguucaaagacgcgcacgcaaaacgacaaaccgucgucguucuuggaucccaggaaggagccguccauacagcacuagcaggcgcccuggaagccgaaauggacggcgccaaggggcggcuaucaucaggccaccuaaaaugucgccuaaagauggacaaacuccgacuaaaaggggucucauacucucuaugcaccgcggcauucaccuucaccaagauccccgcagaaacccuacacggaaccgucacaguagaaguacaauacgccggcacagacggccccugcaaggucccagcccaaauggccguagacaugcaaacacugaccccaguaggacgacuaauaaccgcgaaccccguaauaaccgaaucgaccgaaaacucaaaaaugaugcucgaacuagacccaccguuuggcgacagcuacaucgucaucggcgucggagagaaaaagauaacccaccacuggcacagguccggaagcaccaucgguaaggcuuucgaagcaaccguccgcggagccaaacgcauggccguccuaggagacacagcaugggauuucggcagcgucggcggagcccugaacagccucggaaaaggaauacaccaaauauucggagccgcguucaaaagccuauucgggggcauguccugguucucacaaauccuaaucggcacacuacugauguggcucggccucaacaccaaaaacgggagcauuagccucaugugucuagcucuaggcggcguacuaaucuuccuauccacagcagugagcgcggac

SEQ ID NO: 2824 - RNA, 2106 nt, Artificial Sequence
  ZIKV prME variant CDS opt
cgcaucauaaacgccagaaaagaaaagaaacgaaggggagccgacacaucaguaggcaucgucggacuacucuugaccaccgcaauggccgcggaagucaccagaaggggcucagcauacuacauguaccuagaccguaacgacgccggagaagcaaucuccuuccccaccacccuuggaaugaacaaaugcuacauacaaauaauggaucuaggccauaugugcgacgccaccauguccuacgaaugccccaugcucgacgaaggaguagagcccgacgacguggacuguugguguaauaccaccagcacaugggucgucuaugggaccugccaccacaagaaaggcgaagcacgaagaagucgacgagcaguaacacuaccgagccacagcacccgaaaacuacaaacaagaagucaaacauggcuagaaagccgagaauacacgaaacaccuaauaagaguagagaacuggauauucagaaacccaggguucgcccucgccgccgcggccaucgcauggcugcuaggcuccagcacaucgcaaaaaguaauauaccuagucaugauucuacuaaucgcacccgcauacagcauccgcugcauaggcgucucgaaccgcgacuucgucgagggcaugucaggaggcacauggguggacaucgucuuagaacacgguggaugcgucaccgucauggcccaagacaaacccaccguagacaucgagcugguaaccaccaccguauccaacauggccgaagugcgguccuacugcuacgaagccucaauaagcgacauggccuccgacagcagaugcccaacccaaggggaggcguaucucgacaaacaaagcgacacccaauacgucugcaaacgaacacucguagaccgcggguggggaaacggcugcggacucuucggaaaaggcagccucguaaccugugccaaauucgcaugcucgaagaaaaugaccggaaaauccauacaaccagagaacuuagaauaccgcaucaugcuaagcguacauggcagccaacacagcggcaugauaguaaacgacacaggccaugaaacagacgaaaaccgagcaaaagucgaaaucacccccaacagcccgagagcagaagccacacuaggaggauucggcagccuaggccuggacugcgaaccaaggacaggccucgacuucagcgaccucuacuaccucaccaugaacaacaagcacuggcuaguacacaaagaaugguuccacgacauaccacuccccuggcacgcaggcgccgacacagggacaccccauuggaauaacaaagaagcacugguagaguucaaagacgcccacgccaagagacaaaccguaguaguacuaggcucccaggaaggggcaguccacacagcacuagcgggagcacuggaagcagaaauggacggcgccaaagggcgacuaagcagcggccaccugaaaugcagacuuaaaauggauaaacuacgacuaaagggcgucagcuacagccucugcaccgcugccuucacauucacgaaaauccccgccgaaaccuuacacggcacggucacagucgaaguacaauacgccggaaccgacgguccaugcaaaguacccgcacaaauggccgucgacaugcagacacuaacacccgucggacggcuaauaacagccaaccccguuaucacagaaucgaccgaaaauucaaaaaugaugcucgaacuagacccaccguuuggagacuccuacaucguaaucggcgucggagaaaagaaaaucacacaccacuggcaccgcagcggcuccacgauagggaaagcauucgaggccaccguccgaggagcaaaaagaauggccguccucggcgacacagcaugggacuucggcagcgucggaggcgcgcucaacagucucggaaaaggcauccaccaaauauucggcgcagcauucaaaagccuuuucggcggcaugagcugguuuucacaaauccuaauaggaacccuccucauguggcucggccuaaacaccaaaaacgggucaauaagccuaaugugccuggcccucggcgggguccuaauauuccucuccacggcagucagcgca

SEQ ID NO: 2825 - RNA, 2100 nt, Artificial Sequence
  ZIKV prME variant CDS opt
auaaacgcccgaaaagagaaaaagcgccgaggagccgacacauccguagguauagucggccucuuauuaacaacagcaauggcugccgaaguaacaagacgcggcagcgcauauuacauguaccuugaccgaaacgaugcaggggaagcaauaucauuuccaacaacacuuggcaugaacaaaugcuauauccaaaucauggacuugggacacaugugcgacgccacaaugucauacgaaugcccgaugcuagacgaagggguggaaccggacgacguugacugcuggugcaacacaacuucaaccuggguagucuacggaaccugccaccacaagaaaggcgaagcaagaagauccagacgggccgucacacuccccagccacagcacuagaaaacuacaaacccgaagccaaacauggcucgaaagccgcgaauacacaaagcaucugauccgaguggaaaacuggaucuuccgaaaccccggcuucgcccucgccgccgcagccauagcauggcuccugggauccuccacgucacaaaaagugauauaccuaguaaugauccugcucauagccccggccuacuccauacgcugcauaggcguaagcaaccgagacuucguagagggaaugucagggggcaccugggucgacaucguccuagaacacgggggcugcgucacagucauggcgcaagacaagcccacagucgacaucgagcucgucacaacaaccguaucaaacauggcagagguaagguccuacugcuacgaagcgucaaucucagacauggccagcgacucccguugccccacacaaggcgaggccuaccuagacaaacaauccgacacacaauacguaugcaaacgaacacucguagaccggggcuggggaaacggcugcggacucuucggcaaaggcagccucgucacaugcgcgaaauucgccugcucaaagaaaaugaccggaaaaagcauccaacccgagaaccuagaauaccgaauaaugcuaagcguacacgggucccaacacuccggaaugaucgucaacgacaccggacacgaaaccgacgaaaacagagcuaaaguagaaaucacgccaaacucgccacgcgcagaagccacgcucggaggauucggaucacuagggcuagacugcgagccacgcaccgggcuagacuucuccgaccuauacuaccuaaccaugaacaacaaacacuggcuuguucacaaagaaugguuccaugacaucccccuccccuggcacgcaggagccgacacaggaaccccacacuggaacaacaaagaagcccuaguagaguucaaagacgcacaugcaaaacgccagaccgucgucguacuaggaucccaagaaggagcuguccauaccgcacucgccggcgcccucgaagccgaaauggacggagccaaagggcgccuaagcuccggacaccucaaaugccgacuaaaaauggacaaacuaagacugaaaggcgucagcuacagccuaugcacagccgcauucacauucaccaaaauuccagcagaaacgcuccacggaacagucaccguagaaguacaauacgccggcacagacggccccugcaaagugccagcccaaauggcgguagacaugcaaacacucacaccagucggccgccuaauaacggcuaacccaguaaucaccgaaagcaccgaaaauagcaaaaugaugcuugaacucgacccgcccuucggagacagcuacaucgucaucggcgucggggaaaagaaaauaacacaccacuggcaccgaagcggguccacaaucggcaaagccuucgaagcaaccguaaggggcgcaaaacgcauggccguacucggagacacggccugggacuucgguuccgucggaggcgcacuaaacagccugggcaaaggcauccaucaaaucuucggagcagcauucaaaucacuuuuugggggaaugagcugguucucccaaauccugaucggcaccuuacuaauguggcugggccuuaacaccaaaaauggcagcaucucgcucaugugccucgcacucggaggaguccuaaucuuccugagcacagccguauccgcc

SEQ ID NO: 2826 - RNA, 2103 nt, Artificial Sequence
  ZIKV prME variant CDS opt
auaaucaacgcaagaaaggaaaagaaacgccgcggugccgacacaucaguaggcauagucggccuccuccucacgacagcuauggccgcagaaguaacacgacgcggaagcgcguacuacauguaccucgaccgcaacgacgccggagaagcgaucuccuucccgaccacacucggcaugaacaaaugcuacauccaaaucauggaucucggacacaugugcgacgccaccauguccuacgagugcccaaugcuagacgaaggagucgaacccgacgacguagauugcuggugcaacacgaccuccacaugggucguuuacggaaccugucaccacaagaagggcgaagcccgacgaagccgcagagcagucacccuacccagccacuccacucgcaaacuccagacacgaagccaaacauggcucgagagccgagaguacacaaaacaccucauaaggguagaaaacuggaucuuccgaaauccaggcuucgcccuagccgcagccgccaucgcguggcuucuaggcucaagcacgucacaaaaggucaucuaccucgucaugauccuacuaaucgcuccagccuauucaauccggugcauagguguaagcaaccgagacuucguagaaggcaugucaggaggaacauggguagacaucguccuggaacauggcggaugcguaaccgucauggcccaagacaaacccacaguagacaucgaacucgugaccaccaccguaagcaacauggcagaaguccgaagcuacugcuacgaggcuucaaucagcgacauggcaucagacagcagaugccccacacaaggcgaagccuaccuagacaagcagucagacacccaauauguaugcaaacgcacccuagucgauaggggauggggaaacggaugcggacucuucgguaaaggcagucucgugaccugcgcgaaauucgcgugcuccaagaaaaugacgggcaaaagcauucaacccgaaaaccuagaauacagaaucaugcuaucaguccacggcucccaacacuccggcaugauugucaacgacaccggccacgaaaccgacgaaaaccgagcaaaagucgaaaucacacccaacagcccgcgcgccgaagccacacucggcggcuucggcagccugggccucgacugugaaccccgcacaggacuagacuucagcgaccucuacuaccugacaaugaacaacaaacacuggcucguccacaaagaaugguuccacgacauuccccuccccuggcacgccggcgcagauaccggaaccccacacuggaacaauaaagaagcacucguagaguucaaggacgcgcacgcaaaacggcaaacagucgugguccugggcucgcaagaaggcgcaguccacacagcccucgccggcgcccuagaagccgaaauggacggagcaaaagguagacucagcucaggacaccuaaaaugcagacucaagauggacaaauuacgccucaaaggcguaucuuacucccuaugcaccgccgcauucaccuuuaccaaaaucccggcagaaacgcuccauggaacagucaccgucgagguccaauacgccggaaccgauggaccuugcaaaguccccgcccaaauggcgguugacaugcagacccugacccccgucggccgacucaucaccgccaacccagucaucacugaaagcacagaaaacuccaaaaugaugcucgaacucgacccacccuucggcgacaguuacauugucaucggcgucggggaaaagaagaucacacaccauuggcaccgguccggaagcacgauuggaaaggccuucgaagcaaccgucagaggagccaaaagaauggcgguacucggcgacaccgcaugggacuuuggcuccgucggcggagcacuuaacucacucggaaaaggcauacaccaaauauucggugcugccuucaaaucacucuucggcggcaugagcugguucucacagauacuaaucggaacacuacuaauguggcuaggccucaacaccaaaaacggaagcauaucacuuaugugccuagcccucggcggaguacuaaucuucuuguccacagcagucuccgcc

SEQ ID NO: 2827 - RNA, 2097 nt, Artificial Sequence
  ZIKV prME variant CDS opt
aacgccagaaaagaaaagaaacgaagaggcgccgacaccagcguuggaaucgucggacuacuacuaaccaccgcgauggcagccgaagucacgagaaggggaagcgccuacuacauguaccuagacagaaacgacgcaggcgaggcaauaaguuuccccacaacgcuaggaaugaauaaauguuacauacaaauaauggaucucggacacaugugcgacgcaacaaugagcuacgaaugcccaaugcuagacgaaggagucgaaccagacgauguggacugcuggugcaacacaacuagcacaugggucgucuacggcacaugccaccacaagaaaggagaagcacgaaggagucgcagagccgucacgcuacccagccacucaacgagaaaacuccagaccaggagccaaacguggcuagagagcagagaauacacaaaacaccuaauaagagucgaaaacuggaucuuccgaaacccaggcuucgcccucgccgccgcagccauagccuggcuccuagguucuaguaccagccaaaaaguaauauaccuagugaugauccuacugauagcacccgcauacuccauccguugcauaggagucagcaaccgcgacuucguagaaggaaugagcggaggaaccugggucgauaucguacuagaacacggcggcugcgucacagucauggcccaagacaaaccaaccgucgacauagaacucgugacaacaacaguuagcaacauggcggaagugcgaagcuacugcuaugaagccuccauaucagacauggcaucggacagccgauguccaacacaaggagaagccuaccuagacaagcaauccgacacacaauacguaugcaaaagaacccuagucgaucgaggcuggggcaacgggugcggccuuuucggaaaaggaagccuggucacaugcgccaaauucgcgugcagcaagaaaaugacaggcaaaucaauccaaccagaaaaccucgaauaucgaaucaugcucucgguacacggcagccaacacuccggaaugaucguaaacgacacaggucacgagacagacgaaaacagagcaaaagucgaaaucacgcccaacagcccaagagccgaagcaacacucggcggguucgggagccuaggacuagacugcgaaccccgaacaggccucgacuucucggaccucuacuaucuuaccaugaacaacaaacacuggcuaguccacaaagaaugguuccacgacaucccccuccccuggcacgcaggggcagacaccggaacgccgcauuggaacaauaaagaggcucuagucgaguucaaggacgcacacgcgaaaagacaaaccgucgucguauuaggcucacaagagggcgccguccacacagcgcucgcaggggcacuagaagccgagauggacggcgcgaaaggaaggcuaucaucaggucaccucaaaugccggcuuaagauggacaaacugagacuaaaagggguauccuauucacucugcacagcagcauucacauucacaaaaauccccgcagaaacacugcacggaacaguaaccguagaaguccaauacgcaggcaccgacggcccaugcaaaguaccugcccaaauggccguagacaugcagacccuaacgcccgucggccggcucaucacggccaacccgguaauaacugaaucaacagaaaacucuaaaaugaugcuggaacuggacccacccuucggcgacaguuacauagucaucggugucggugaaaagaaaaucacccaccacuggcacagaagcggaagcacuauaggcaaagcguucgaagccacaguaagaggcgcaaaaaggauggcaguacuaggagacaccgccugggacuucggcucaguaggaggagcacuaaacucgcucggcaagggaauccaccaaauauucggagccgcauucaagagccuauucggcggaaugagcugguucucacaaauccuaaucggaacgcugcuaauguggcucggccuaaacacaaagaacggcagcaucagccuaaugugccucgcccucgggggcguccuuauauucuugagcacagcaguaagcgcc

SEQ ID NO: 2828 - RNA, 2094 nt, Artificial Sequence
  ZIKV prME variant CDS opt
gccaggaaagagaaaaagagaagaggcgcggacacaucaguaggaauagucggacuacugcuaacaaccgccauggcagcagaaguaacccgaagaggcucagccuacuacauguaccucgaccgaaacgacgccggagaagccauaucauuccccaccacccucggaaugaacaaaugcuacauccagaucauggaccucggccacaugugcgaugcaaccaugagcuacgaaugcccaaugcucgacgaaggcguagaaccagacgacguagacugcuggugcaacacaaccaguacguggguagucuauggcacaugccaccacaagaaaggcgaagcacgcagaagccgccgcgcagucacucucccaucucacagcaccagaaaacuccagacaaggagccagaccuggcuggaaucccgagaauacaccaaacaccuaauaagggucgaaaacuggauuuuccgcaacccaggcuucgcacucgcagccgcagccauagccuggcuacugggcagcagcacaagccaaaaagugaucuaucucgucaugauacuccugauugccccagcuuacuccaucagaugcaucggcguaagcaaccgagacuucgucgaggggaugucgggaggaaccuggguugacaucguacucgaacacggcggaugcguaaccguaauggcucaagacaaacccaccguugacauagaacuggugacaaccacaguauccaacauggcagaggugagaucauacugcuacgaggcuucaaucucugacauggccucggacagccgcugccccacacagggggaagcguaccucgacaaacaaucagacacacaguacgucugcaaacgaacccucguagaccgcggauggggcaacgggugcgggcuauucggcaaaggaucacucgucacaugcgcaaaauucgcuugcucgaagaaaaugacaggcaaaagcauacaaccagagaaccucgaauacagaauaaugcugucaguacacggcucacaacacagcggaaugauugucaacgacacaggacacgagaccgacgaaaacagggccaaaguagaaauaacccccaacagcccccgagccgaggcaacacuuggaggauucggcucccuaggauuagacugcgaaccgcgcaccggacuggacuuuagcgaccuauacuaccucacaaugaacaacaaacacuggcuaguccacaaagagugguuccacgacauaccccucccauggcaugccggagcagacacaggaaccccacacuggaacaacaaagaagcgcugguagaguucaaagacgcccacgcaaaacgccaaacagucgugguccucggcagccaagaaggcgccguccacaccgcacucgccggcgcacuagaagcagaaauggacggcgcgaaaggccggcucagcuccgggcaccuaaaauguagacuaaaaauggauaagcuacgccuaaaagggguaucauacagccuaugcaccgccgccuucacauucacaaaaauaccggcagaaacacugcacggaacaguaacagucgaaguacaauacgcaggaaccgauggcccaugcaaaguuccagcccaaauggcagucgacaugcaaacacugaccccggucggaagacuuaucacagcaaaccccgucaucacagaaucaaccgaaaacagcaaaaugaugcucgaacuagacccaccauucggcgacaguuacauagugauaggcguaggagagaagaaaaucacccaucacuggcacagauccgggagcacuauagggaaagccuucgaggccacaguaaggggagccaaacgcauggccguccucggugacacagcaugggacuucggcucaguaggcggcgcccucaacucccucggaaaaggaauccaccaaauauucggggccgcauucaagagccuguucgggggcaugagcugguucucccaaauccuaauaggcacccuccucauguggcuaggccucaauaccaaaaacggaaguaucucacucaugugccuagcacuaggcggcguccucauauuccucagcacagccguuagcgcg

SEQ ID NO: 2829 - RNA, 2091 nt, Artificial Sequence
  ZIKV prME variant CDS opt
cgaaaagagaagaaaagacgcggagcagacaccagcgucggaaucgucggccuucuccucacuacagccauggccgccgaagucacgagacgcggauccgcauacuacauguaucuagaccgaaacgacgccggcgaggcaaucucauuccccaccacccucggcaugaauaaaugcuauauccagauaauggaccucggccacaugugcgacgcaacaaugagcuacgaaugccccaugcucgacgagggaguagaacccgaugacguugacugcuggugcaacacaaccucgaccugggucguguacggcacaugccaccacaagaaaggagaagcgagacgcucccgucgagcaguaacccuuccaucccacagcacccggaaacuccaaacacgcucccaaaccuggcucgaaucccgcgaauauacaaaacaucuaauccgaguagaaaacuggaucuuccgcaacccgggauucgcccuggcagcggccgccaucgccuggcuacucgguagcuccaccagccaaaaaguaaucuaccucguuaugauacuacuaaucgccccagcauacucaauacgcugcaucggcguaagcaaccgagacuucgucgaaggaaugucaggcggcaccugggucgacaucguccuagaacacggcggaugcgucaccgucauggcgcaagacaaaccaaccguagacauagagcuaguaacaaccaccguaucaaacauggccgaaguccgaagcuacugcuacgaagcaucgauauccgacauggccuccgacucacgcugccccacccaaggagaagccuaccuagacaaacagucggauacgcaauacgucugcaaacgaacccuagucgaccgaggcuggggaaacggcugcggccucuucggaaaagggucccuaguaaccugcgcaaaauucgcaugcagcaagaaaaugacaggcaaguccauccagcccgaaaaccucgaauaucgaauaaugcucuccguccacggcucacaacacagcggaaugaucgucaacgacaccggacacgaaaccgacgaaaaccgagcaaaagucgagauaaccccaaacucaccucgcgcugaggcaacacucggaggcuucggcucccucggacucgacugcgaaccacgaaccgggcuagacuucagcgaucuauauuaccucaccaugaacaacaaacacuggcuaguccacaaagaaugguuccacgacauaccacuccccuggcacgccggcgcagacaccggcacgccccacuggaacaacaaagaagcccuggucgaguucaaagacgcccacgccaaacgucaaaccgucgugguacucgggucccaagaaggagcaguccacacagcacuugcgggcgcccuggaagccgaaauggacggcgccaaaggacgucucuccagcggacaccuaaagugccgccugaaaauggacaaacuacgacuaaagggagucucauacagcuuaugcaccgccgccuucacauuuaccaaaauacccgcagaaacgcuacacggcaccguaaccgucgaaguacaauacgcgggaacagacggacccugcaaaguaccugcucaaauggccguagacaugcaaacacucacaccagucggaagacuaaucacagcaaaccccguaaucaccgaaagcaccgaaaauuccaaaaugaugcucgaacuagacccaccguuuggagacucuuacaucguaauaggagugggcgaaaagaaaaucacacaucacuggcaccgaucgggaucgaccauagguaaagccuucgaagcaacagugcgaggcgccaaacgaauggcuguacuuggagacaccgcaugggauuuuggcuccguuggaggagcccuuaacagccucggcaaaggcauacaccagauuuucggcgcagccuucaaaucccucuucggcggcauguccugguucucccaaauccucaucggaacccuacucauguggcuaggccucaacacgaaaaacggaucaauaucccucaugugccuagcacugggcgguguacuaauauuccucuccaccgccgucucagcg

SEQ ID NO: 2830 - RNA, 2088 nt, Artificial Sequence
  ZIKV prME variant CDS opt
aaagagaaaaagaggagaggcgcggacacguccgucgguauaguaggccuacuucuaacaaccgccauggccgcagaaguaacccgucgaggaagcgccuacuacauguaccucgaccgaaacgacgccggcgaagcgaucagcuuccccaccacccucggcaugaacaaauguuacauccagauaauggaccucggccacaugugcgacgccacgaugucauacgaaugccccaugcuugacgaaggcguugaaccagacgacgucgacugcuggugcaacacuacaagcaccuggguggucuacggcacuugccaccacaaaaagggagaagcacgccgcagccgucgagccguaacccuucccucacacagcacccgaaagcuccaaacccgcucccaaaccuggcuagaaucucgagaauacaccaaacaccucauuagagucgaaaacuggauauuccgcaauccaggcuucgcccuagcagcagccgcaaucgccuggcuucucggauccucaacaucacagaaagucauauaccucguuaugauacuccuaaucgccccagccuacagcaucagaugcaucggcgucagcaaccgagacuucguagaaggcaugagcggaggaacauggguagacaucguccucgaacacggaggaugcgucaccguaauggcccaagacaaacccacaguugacauugagcuagucacaaccaccgugagcaacauggccgaagugcgcagcuacugcuacgaagccuccauaucagacauggcaucagacagccgcugcccuacacagggagaagcauaccuggacaaacaguccgacacacaauacgucugcaaacgaacccucguagaccgaggcuggggaaacggaugcggacuauucggcaaaggcucccucgucacaugcgcaaaguucgccugcagcaagaaaaugaccggcaaaucuauccagcccgagaaccucgaauacagaauaaugcucuccguacacggaucccaacacagcggcaugaucgucaacgacacaggacacgaaacugacgaaaaucgcgcgaaagucgaaaucacacccaacuccccucgagcggaagcuacccugggcggcuucggcagccuaggccucgauugcgaaccacgaacaggcuuagacuucuccgaccucuacuaccuaacgaugaacaauaaacacuggcuaguccacaaagaaugguuccacgacauaccguuaccguggcacgccggggccgauaccggaacaccacauuggaacaacaaagaagcacugguagaguucaaagacgcccacgcaaaacgccaaaccgucgucguacucgggucccaagaaggcgcaguccacacagcccucgcaggagcccucgaagccgaaauggacggcgcaaaaggccgccucagcaguggucaccuaaaaugcagacuaaaaauggacaaacuccgacuaaaaggcgucucguacucccuguguaccgcagcuuucacuuucaccaagauccccgcagaaacccuccacggcaccgucaccguagaagugcaauacgcagggaccgauggccccuguaaaguaccggcccaaauggcagucgacaugcagacccugacacccgugggccggcucaucacagcaaaccccguaauaacagaauccaccgaaaacuccaagaugaugcuagagcuagaucccccauucggcgacagcuacauagucaucggaguaggagaaaagaaaaucacacaccacuggcaccgguccggcuccaccauaggcaaagcauuugaagcuacaguccgcggcgccaaacgcauggcaguacuuggcgacaccgccugggacuucggcuccguaggaggggcgcucaacagccuagggaaaggaauccaccaaaucuuuggagccgcauucaaaucccuauucggcggcauguccugguucucucaaauccugaucggcacccuacucauguggcuaggccucaacaccaaaaacggcuccaucucccuaaugugccuggcacucggaggaguacucaucuuccuauccacagccgucuccgca

SEQ ID NO: 2831 - RNA, 2085 nt, Artificial Sequence
  ZIKV prME variant CDS opt
gagaagaaaagaagaggagcagacaccagcguaggcaucguaggccuccuacucacaaccgcaauggccgccgaaguaacccgccggggcuccgcauacuacauguaccuagaccgcaaugaugccggcgaagcaauaucguuccccaccacccucggcaugaacaaaugcuacauacaaaucauggaccuaggacacaugugcgacgccaccauguccuacgaaugccccaugcuagacgaagggguugaacccgaugacgucgacugcuggugcaauacaacgagcaccugggugguuuacggaacgugccaccacaagaaaggggaggcccgccgcucccgcagagccguaacccuccccucacacagcaccagaaaacuacagacacgaagccagacauggcucgaaucacgagaauacaccaagcaccucauccgcguagaaaacuggauauuccgcaaccccggcuucgcccuagccgcagccgccaucgccuggcuccuuggcuccucaacaagccaaaaagucauauaccucgucaugauucuacucaucgcgcccgccuacuccauccguugcaucggagucuccaacagagacuucgucgaaggcaugucaggaggcaccuggguugacaucguccuugaacacggggguugcguaacggugauggcccaggacaaacccacaguagacauagaacuugugaccacaacuguauccaacauggcggaaguccgcucauacugcuacgaagccagcaucucggacauggccuccgacucccgaugcccaacacaaggcgaagcauaccucgacaaacaauccgacacccaauacgucugcaaacggacacucgucgaccgcggauggggaaacggcuguggucuauucggcaaaggaucccuagugaccugcgcaaaauuugcuugcucaaagaaaaugacgggaaaaucaauccagcccgaaaaccucgaauacagaaucaugcuuuccguccacggcagccaacacagcggaaugauagucaacgacaccggccaugaaaccgacgaaaaccgggccaaaguagaaaucaccccaaacucaccccgcgcagaagccacccucggaggguucggaagccucggacucgacugcgaaccacgcacuggacuagacuucucagaccuguacuaucucacgaugaacaauaaacauuggcuaguacacaaagagugguuccacgauauaccacuaccauggcacgccggagcagacacaggcacaccccacuggaacaacaaagaagcccucguagaguucaaagacgcacacgccaaacgucaaaccgucguaguacucgguucacaagagggcgcuguacacaccgcacuagccggcgcccucgaagccgaaauggauggagccaaagggcgccuauccucaggccaccuaaaaugccgacucaaaauggacaaacuucgccucaaagggguaucauacucccuaugcacagccgccuucaccuucacaaagauacccgccgaaacauuacacggcaccgucacagucgagguccaauacgccggcaccgacggacccugcaaagucccggcacagauggcaguagacaugcaaacccucacacccgucggccgccuaauaacagcaaaccccgucaucaccgaaucaaccgaaaacagcaaaaugaugcuggaacucgacccacccuucggcgacuccuacaucguaaucggcguaggcgaaaagaaaauaacccaucacuggcacagguccgguagcaccaucggaaaagcauucgaagcaaccguccgaggcgccaaacggauggcuguacuaggagacacugccugggacuucggcuccguuggcggcgcccuaaacucgcuaggcaaaggaauccaccaaaucuucggcgccgccuuuaaaagccuauucggaggaaugagcugguucucacaaauccucaucggaacacuacuaauguggcugggacugaacaccaaaaacggaagcauaucacuuaugugccucgcacuagguggcguucuuaucuuccucagcacagcgguaucugca

SEQ ID NO: 2832 - RNA, 2082 nt, Artificial Sequence
  ZIKV prME variant CDS opt
aagaaacggcgaggcgccgacacaagcgucggcaucguaggccuacuccuaaccaccgcuauggcagccgaaguaacacgccgaggaagcgcauacuauauguaccuagaucgcaacgacgcaggcgaggccaucagcuuccccaccacauuaggcaugaauaaaugcuacauccaaauaauggaucuaggccacaugugcgaugccacaaugaguuacgaaugcccaaugcucgacgagggagucgaacccgacgacguagacugcuggugcaacaccacuucaacaugggucguauacggaaccugccaccacaagaaaggcgaagcaaggagaucaaggagagcugucacgcuccccucacacagcacccgcaaacuacaaacacggucccaaaccuggcuggaaagccgagaguauacaaaacaccuaauccgcgucgaaaauuggauauucagaaaccccggcuucgcgcucgcagcagccgcaauagcauggcuacucggcucaagcacuucacaaaaagucaucuaucuagucaugauccuucucaucgcaccagcauacaguauacgcugcauagggguaagcaaccgggacuucguugaaggaauguccgggggcacguggguagacauaguacuagaacacggaggaugcguaacgguaauggcccaagacaaacccacaguggacaucgagcuaguaacgacaacagucagcaacauggccgagguacggucauacugcuacgaggcaagcauaucagacauggcauccgacucaaggugccccacacagggcgaggccuaccucgacaagcaaagcgacacacaauacgucugcaaacggacccucguagauagaggcuggggcaacggaugcggccucuucggaaaagggagccuaguaacaugcgcaaaauucgccugcagcaagaaaaugaccggaaaaagcauacaaccagaaaaccuugaauaccgcauaaugcuaagcguacacggcagccaacacagcgguaugaucguaaacgacacaggacacgaaaccgacgaaaauagagcaaaaguagaaauaacaccgaacuccccucgggcagaagccacacucgggggauucggaagccuaggccuagacugcgagcccagaaccggacuggacuucagcgaccucuacuaccuaacaaugaacaacaagcacuggcuaguacacaaagaaugguuccacgacauaccucucccauggcacgcaggggcagacacaggcacaccccacuggaacaauaaagaagcccuaguggaguucaaagacgcccacgcaaaaagacaaaccguaguaguccucggaagccaagaaggcgccguccacaccgcgcuagccggggcgcuggaagcggaaauggacggcgccaaaggacgacuaagcagcggccaccuaaaaugccgacuaaaaauggacaaacuaaggcucaaaggcguauccuacucacucugcacagccgccuucaccuucacaaaaauaccagcagagacgcuccacggcacagugacgguggaaguccaauaugccggcacagacggaccaugcaaggugccagcacaaauggcggucgacaugcaaacacuaacacccguaggccgccuaauaaccgccaaccccguaaucaccgaaagcacggaaaauucgaaaaugaugcuagagcucgacccaccguucggagacucauacaucgucauaggagugggcgagaaaaagauaacacaccacuggcaccgaagcggcuccacaaucggaaaagcauucgaagccacaguaagaggggccaagagaauggccguacucggagauacagcaugggauuucgggucaguaggcggagcccuaaacagccuaggcaaaggcauccaccagaucuucggagcagcauucaaaagucucuuuggaggaauguccugguucucccaaauacugaucggcacacuacugauguggcugggacuaaacaccaaaaacgggagcaucucacucaugugucuggcacugggcggaguacucaucuuccuaagcacagccguaucagca

SEQ ID NO: 2833 - RNA, 2079 nt, Artificial Sequence
  ZIKV prME variant CDS opt
aaaagacgcggcgcggacaccuccgucggcauagucggucuucugcucacaacagcaauggccgcagaggucacacgaagaggcagcgccuacuacauguaccucgaccgaaacgacgcaggcgaagcaaucucauuccccacaacccuaggcaugaacaaaugcuacauccagauaauggaccuaggccacaugugcgacgccacaauguccuacgaaugcccuauguuagacgaaggaguugaaccagacgacguagacugcuggugcaacacaacaucaacgugggugguguauggcacaugccaucacaagaaaggagaagccagacgcagcagacgagcagucacccuacccagccacucaacacgaaaacuccaaacacggucacagacauggcucgaaagccgcgaauacacgaaacaccuaauccgggucgagaauuggaucuuccgcaauccaggauucgcccucgcagccgcagccaucgccuggcuacuaggaagcuccaccucacaaaaagucaucuaccucgucaugauacuccuaauagcaccagccuacuccaucagaugcauaggcgucagcaaccgcgacuucguagaaggaaugaguggcggcaccugggucgacaucguccuagaacacggcggaugcguaaccgugauggcgcaggacaaacccaccguggacauagagcuagucaccaccaccgucucgaacauggcagaaguacgauccuacugcuacgaagccagcauaagcgacauggcaagcgacagucgcugccccacccaaggagaagccuaccuagauaaacaaagcgacacccaauacgucuguaaacgaacccuagucgaccgcggauggggcaacggcuguggacucuucgggaaaggcucacuggugacaugcgccaaauucgcgugcucuaagaaaaugacagggaaaucuauccaacccgaaaaccuagaauaccgcaucaugcuaagcguacacggcucacaacacuccggcaugauaguaaacgacacaggacacgaaaccgacgagaacagagccaaaguagaaaucacgcccaacucccccagggccgaagcaacccucggcggcuucggaucccuugggcuagacugcgaacccagaaccggacucgacuucagcgaccucuacuaccuaacaaugaacaacaaacacugguuagugcacaaggaaugguuccacgacaucccacuaccauggcacgcgggagcagacacuggcacaccccacuggaacaacaaagaagcucucgucgaguucaaggacgcccacgccaaaaggcaaacagucgucguccuagggagccaggaaggagccgugcacaccgcacucgcuggcgcccuggaagccgaaauggacggagccaaaggcagacuaucaagcggacacuuaaaaugcagacuaaaaauggauaaacuccgucuaaaaggcguaagcuacagccuaugcaccgccgcguucacauucaccaaaauaccagcagaaacucuccacggcaccgugacaguagaaguccaguacgccggcacggauggaccauguaaaguaccggcccaaauggcaguagacaugcaaacacucacacccguaggacgccuaaucaccgcaaaccccgugauaaccgaaucaaccgaaaacagcaaaaugaugcucgaacucgacccaccauuuggagauagcuacaucgugaucgggguaggagagaaaaagaucacgcaccauuggcaccgcucaggcucaaccauaggaaaggccuucgaagcaaccguacgaggagcaaaacgcauggcaguacuaggagacacugccugggacuucggcucaguaggcggagcacucaacucccuaggcaaaggaauacaccaaaucuucggcgccgccuucaaaagccucuucggcgguauguccugguucagccaaauccugaucggcacacuucuaaugugguuaggacucaacaccaaaaacggcuccaucucccuaaugugccuagcacucggcggcguacucaucuuccuaagcacagcaguguccgca

SEQ ID NO: 2834 - RNA, 2076 nt, Artificial Sequence
  ZIKV prME variant CDS opt
agacgaggcgccgacacaucaguuggaauaguaggacuacuacuaaccacagccauggccgcagaaguaacaagacgcggauccgccuauuacauguaccuagaccgaaaugacgcaggcgaggcgaucagcuucccaacaacgcugggaaugaacaaaugcuacauacaaauaauggaccuuggccacaugugugacgcaacaaugagcuacgaaugccccaugcucgacgagggcgucgaaccagacgacguagacugcuggugcaauacaacaagcaccuggguagucuacggaacaugccaccacaaaaagggagaagcacgacgcagccgccgagcgguaacccuccccagccauucgacccggaaacuacagacccgaagccaaaccuggcuagaaucacgcgaauacaccaaacacuuaaucagaguggagaacuggaucuuccgcaaccccggauucgcacuagcagcagccgcaauagcauggcuccuaggcagcagcacaagccaaaaggucauauaccucgugaugaucuuacucauagccccagccuacagcauacgaugcauaggcguguccaacagagacuucgucgaaggcaugagcggaggcacauggguagacauaguacucgaacacggcggaugcguaacggugauggcccaagacaaaccaacaguagauaucgaacuggucaccaccacagucagcaauauggcagaaguaagauccuacugcuacgaagcauccauaagcgacauggcaagcgauagcagaugccccacacagggcgaagccuaccucgacaaacaaucagauacacaauacgucugcaagcgcacccuggucgacagaggcuggggaaauggaugcggccuauuuggaaaagggucccuggucacgugcgcaaaguucgcgugcagcaagaaaaugaccggcaaaagcauccaacccgagaaccucgaauacagaauaaugcucagcgugcacgggagccaacacagcggcaugauaguaaacgacacuggacacgaaaccgaugagaaccgagccaaagucgaaauaaccccuaacucaccacgagcagaagcgacacuagggggcuucggcagucucgggcuagacugcgagcccagaaccggccucgacuuuuccgaccucuacuaccuaaccaugaacaacaaacacuggcucgugcacaaagaaugguuccacgacaucccacucccauggcacgcaggagcagacacaggaacaccccacuggaacaacaaagaggcacucgucgaguucaaggacgcccacgcaaaaagacaaacaguaguaguucucggaagccaagaaggagcaguacacaccgcccuugcaggggcccucgaagccgagauggacggagcgaaaggccggcuaucgucaggccaccucaaauguagacuaaagauggacaaacucagacuaaaaggagugucauacagccugugcacagccgcguucacauucacaaaaauaccggcggaaacacuccacgggacggucaccguagaggugcaauacgccggcaccgacggccccugcaaagucccggcacagauggccgucgacaugcaaacccucacaccaguaggccgacuaaucacagccaacccgguaauaacggaauccacagaaaacucaaaaaugaugcuagaacucgacccaccauuuggcgacagcuacauagugauagggguaggcgaaaagaaaaucacacaccacuggcaccgaagcggcagcaccauagggaaagcauucgaagcaaccguacggggagcaaaacgcauggcaguacucggggacacagccugggacuucggcagcguaggcggugcacuaaacucacuaggcaagggcauacaccaaauauucggggcggccuucaaaucucuauucgggggcaugagcugguucucacaaauccuaaucgggacccuccucauguggcuaggacucaauacaaagaacggcagcauaucgcucaugugccuggcauuaggaggaguccuaaucuuccucagcacagcaguaagcgca

SEQ ID NO: 2835 - RNA, 2073 nt, Artificial Sequence
  ZIKV prME variant CDS opt
cgcggagcagacaccagcgucggcaucgugggccuccuucugacaacagccauggccgcggagguaacacgaagaggcagcgcguacuacauguaccuagacagaaaugacgcaggagaagccaucucguucccaacaacccuaggaaugaacaaaugcuacauccaaaucauggaccuaggccacaugugcgacgccaccaugagcuacgaaugcccaaugcucgacgaaggaguagagcccgacgacguagacugcuggugcaacaccaccagcacauggguaguauacggaaccugccaccacaaaaagggggaagcucgccgaagccgccgcgcugucacacuccccagccacagcaccagaaaacuccaaacccgcucacaaaccuggcuagaaagccgagaauacaccaaacacuuaauccgaguggaaaacuggauauucaggaaucccggcuucgcccuugccgccgccgcaauagccuggcuccucggcagcucaaccucacaaaaagucauauaccuagucaugauacuccuaauagcccccgccuacuccauaagaugcauaggcguaagcaacagagacuucguagaagggaugucuggcggcaccuggguagacauuguacucgaacacggcggcugugugacagugauggcccaagacaaaccaaccguagacaucgagcuagucacaaccaccgucuccaacauggccgaagucagauccuacugcuacgaagcgagcauauccgacauggcguccgacagccgaugccccacacagggcgaagccuaccucgacaaacaaagcgacacccaguacguauguaaacgcaccuuaguggacagaggauggggcaacggcugcggacucuucggcaagggaucccucgucacaugcgccaaauucgcaugcucgaagaaaaugaccggcaaaagcauccaaccagaaaaccucgaauaccgaauaaugcucucgguacacggcagccaacacagcggaaugaucguuaacgacaccgggcacgagacagacgaaaaccgugccaaagucgaaauaacccccaacagcccaagagcagaggccacccucggcggauucgguagccuaggacuagacugcgagcccagaaccggccuggacuucucagaccucuacuaccuaacuaugaacaacaaacacuggcuaguccacaaagaaugguuccacgacauaccccuacccuggcacgccggagcagacacaggcaccccacacuggaacaacaaagaagcccuaguagaguucaaggacgcacacgcaaaacgccaaacaguuguaguccuuggcagccaagaaggagccguccacaccgcccucgcaggagcccuagaagcagaaauggauggcgcgaaaggccgccuaucauccggccaccuaaaaugcagacucaagauggacaaacuaagacucaagggagucuccuacucccuauguaccgcagccuucacguucaccaaaaucccagcagaaacacuccacggcaccguaaccgucgaaguacaauaugccgguacagacggacccugcaagguaccagcccaaauggccguggacaugcaaacccuaacacccguaggccgccugaucacagcgaaccccguuaucaccgaauccacagaaaacucaaagaugaugcucgaacuagacccacccuucggagacuccuacauagucaucggcgucggggaaaagaaaauaacacaccacuggcaccgcuccggcagcaccauagguaaagcauucgaggccaccguacgaggagccaaacgaauggccguacuaggcgacaccgccugggacuuuggauccgugggcggcgcacuaaacucacuaggcaaaggaauacaccaaaucuucggggcagccuucaaaagccuauucggcggaaugucuugguucucacaaauccucauaggaacacuccugauguggcucggacugaacaccaaaaacggauccauaagucuaaugugccuagcacugggcggaguccuaaucuuccugagcaccgcaguauccgcg

SEQ ID NO: 2836 - RNA, 2070 nt, Artificial Sequence
  ZIKV prME variant CDS opt
ggcgccgacacaucggucggaauagucggacuacuccucacaacagccauggcagcggaagucacgcgaagaggcuccgccuacuacauguaccucgaccgcaacgacgcaggggaagcgaucagcuuccccaccacccucgggaugaacaaaugcuacauacaaauaauggaucuaggacacaugugcgacgcgacgaugagcuacgaaugccccaugcuagacgaaggaguagaaccagacgacgucgacuguuggugcaacacaacauccacuugggugguauauggaaccugccaucacaagaaaggagaagccaggaggucccgcagagccgucacacuccccagccacuccacucgcaagcuacaaacaagaucacaaaccuggcuagaaagcagggaauauacaaaacaccuaauaagaguggaaaacuggaucuucagaaaccccggcuucgcccuagccgcagcggccauagccuggcuacucggcagcuccacaagccagaaagucaucuaccucguaaugauccuucugaucgccccagcguacuccauacgguguauaggaguauccaaccgcgacuucgucgaaggcaugucaggcggaacaugggucgacauaguccucgaacacgguggaugcgucacgguaauggcacaggacaaacccacggucgauaucgagcuaguaacaaccacggucuccaacauggccgaaguccgcucauacugcuacgaagccuccauauccgacauggcguccgacucccgcugcccaacccaaggcgaagccuaccucgacaaacaauccgacacccaauacguaugcaaacgaaccuuagucgaccgcggaugggggaacggauguggccuauucggcaagggcucgcucguuacaugcgccaaauuugccugcucgaagaaaaugacgggaaaaagcauccaacccgaaaaccuagaauacagaauaaugcuaucgguccauggaucacaacacucagggaugauaguaaacgacacgggacacgagaccgacgaaaaccgcgcgaaagucgaaauuaccccaaacaguccucgcgcagaagcaacccuaggcggguucggaagccucggccucgacugcgaaccacggacaggcuuagacuuuagcgaccuguacuaccucaccaugaacaacaaacacugguuaguccacaaagaaugguuccacgacauaccccuaccauggcacgccggagccgauacagguacaccccacuggaacaacaaggaagcgcuaguggaguucaaagacgcccacgcaaaacgccaaaccgucgucgucuuaggcagccaagaaggagccguccacaccgcgcucgccggagcccuagaagcagagauggacggagcaaaaggacgccuaaguucagggcaccuaaagugccgacugaaaauggacaagcugcgucucaaaggcguguccuacucacuaugcacggcggcauuuacguucaccaaaauccccgcagaaacccuacacggaaccgucaccguagaaguccaauaugccggaacggacggacccugcaaggucccagcccaaauggccgucgacaugcagacccugacccccguaggccggcuaauaaccgcaaacccgguaauaacagaaucaacagagaacucaaaaaugaugcucgaacuggacccacccuucggcgacuccuacauagucaucggaguaggagaaaagaaaauaacccaccacuggcaccgcagcggaagcaccauaggcaaagcguucgaggcgaccguccgcggcgccaaaaggauggcaguccuaggagacaccgcaugggacuucggaagcguaggaggcgcccucaacucacuaggaaaaggaauccaccaaaucuucggagcggcguucaaaagccucuucggcggaaugagcugguucucacaaauccucaucggaacccugcuaauguggcucggacuaaacaccaaaaacgggagcaucucccuaaugugucucgcacuagguggcguccucaucuuccucagcacagcaguaucagcg

SEQ ID NO: 2837 - RNA, 2067 nt, Artificial Sequence
  ZIKV prME variant CDS opt
gccgacacaagcguaggaauaguaggacugcuccugaccacagcaauggcagcagaaguaacaagacgaggcuccgcguauuacauguacuuagaccgaaacgacgccggagaagccauaucuuuccccaccacccuagggaugaacaagugcuacauucaaauaauggacuugggccacaugugcgaugcgaccaugagcuacgagugccccaugcuagacgagggcgucgaaccagacgacguagacugcuggugcaacacgaccucaacauggguaguauacgggacaugccaccacaagaaaggagaggcacgaagaagccgacgagccguaacgcuacccucccacucgacacgcaaacuccaaacaagaucccaaacauggcuggaaagcagggaauacacaaaacaccucauuagaguagaaaacuggauauuucgaaacccaggcuucgcccuagcagcagcagcgaucgccuggcuccucggaagcagcaccucgcaaaaaguaauuuaccucguaaugauacuacuaaucgcgccagcauacagcaucagguguaucggaguaagcaacagagacuucguagaaggcaugucaggaggaaccuggguagacaucguacuagaacacggaggaugcguaaccgugauggcucaagacaaaccaaccguagacaucgagcuaguaaccacuacagucuccaauauggcugaagucagauccuacugcuacgaagccucaauuagcgacauggcgagcgacagccgaugcccgacccaaggagaagccuaccucgacaaacaaucggacacccaauacguaugcaaaaggacacuggucgaccgaggcugggggaacggcugcggccuguucgggaaaggcagccucguaacaugcgcgaaauucgccugcuccaagaaaaugacuggaaaaucaauccaaccagaaaaccuggaauacagaaucaugcucuccguacacgggagccaacacagcggaaugaucguaaacgacaccggccacgaaaccgacgaaaaccgcgcgaaagucgaaauaacgcccaacucacccagagccgaggccacacuaggagguuucggaucacuagggcucgacugcgaacccaggaccggacuagacuucagcgaccucuacuaccucacaaugaacaacaaacacuggcuagugcacaaagaaugguuucacgacauaccccuacccuggcacgcaggcgcagacaccggcacgccccacuggaacaacaaagaagcacucgucgaguucaaagacgcccacgccaaacgccagaccguagucguccuaggaagccaagaaggagcaguccacaccgcccuagcaggggcucuagaagccgaaauggacggcgcaaagggacgacucagcagcggccaccuaaaaugccgccugaaaauggacaaacucagacucaaaggaguaucauacucacuaugcacagcagcauucacauucaccaaaauccccgcagaaacccuccauggaacagucacagucgaaguucaauaugccggcacagacggaccaugcaaaguacccgcacaaauggccguagacaugcagacgcuaacccccgucggaaggcucauaacagcuaaccccgucauaaccgaaagcacagaaaacuccaaaaugaugcucgaacucgaucccccguucggcgacucguacauugucauaggcgucggagaaaagaaaaucacacaccacuggcaccgcucaggcagcacaaucggcaaagccuucgaagcgacaguacggggagccaaacgaauggccguccucggagacacagccugggacuucggaagcgucggaggagcccuuaacagucugggaaaaggaauccaccaaaucuucggggcagcuuucaaaagccucuucggcggcaugagcugguucagccaaauccuaaucggaaccuuacuaauguggcucgggcugaacacgaaaaacggguccauaagccucaugugccucgcccugggcggaguccucauauuccuaagcacagccgucuccgcc

SEQ ID NO: 2838 - RNA, 2064 nt, Artificial Sequence
  ZIKV prME variant CDS opt
gacacaagcgucggaauagugggucuccuacucacgaccgcaauggccgcagagguaacccgaaggggcucugcauacuacauguaccuggaccgcaacgacgcaggcgaagccauaucauuccccacgacacucggaaugaacaaaugcuauauacagaucauggaccucggacauaugugcgacgccaccauguccuacgaaugccccaugcuagacgaaggcguggaaccagacgacgucgacugcugguguaacaccacgagcaccuggguagucuacggcacaugccaccacaagaaaggggaagccagaagaucacgccgagcgguaacgcucccgucacacuccacaagaaaacuacagacacgaagccaaaccuggcucgaaagccgcgaauacaccaagcaccuaauaagaguagagaacuggauuuuccgaaacccuggguucgcgcuagcagcugcagcaauagccuggcuccuagggagcucaacgucacagaaagucaucuaccucgucaugauacuacugaucgcacccgccuacuccauccgaugcauaggcgucucaaaccgcgacuucguagaaggcauguccggagggaccugggucgauaucguucucgaacacggaggaugcguaacagucauggcccaggauaaacccacaguagacauagaacucguaacaacgacagucucaaacauggccgaaguaagguccuacugcuacgaagcaucaaucucggacauggccuccgacucacgaugccccacccaaggcgaagccuaccucgacaaacaaucagacacccaauaugucuguaaacggacccucguagaccgcggcuggggcaacggaugcggccuauucggcaaaggcucccuagugaccugcgccaaauucgcaugcucaaagaaaaugacaggcaaaagcauacaacccgaaaacuuagaauaccguaucaugcuuuccguacacggcagccaacacuccggcaugaucgucaaugacaccggccacgaaacugacgaaaauagagcaaaaguagaaaucacaccaaacagcccacgagcggaagcgacgcucggcggcuuuggcucacucggccucgacugugagccaagaacaggacuagacuucuccgaucuauacuaccucacgaugaacaacaaacauuggcuaguacacaaagaaugguuucaugauaucccccuaccuuggcacgccggagccgacacaggaacaccucacuggaacaauaaagaggcacucguagaguucaaagacgcacacgccaaaagacaaaccguagucguccuuggcucacaagaaggcgccguacacaccgcccucgccggagcacucgaagccgagauggacggcgccaaaggccgacuaucuagcggccaccucaagugcaggcucaagauggauaaacuacgacucaagggaguaucauacucccuaugcaccgcagcauucacguucacaaaaauacccgcagaaacccuacacggcacagucacaguggagguacaguacgccggcacagacggaccauguaaagucccagcacagauggccguugacaugcagacccuaacccccgucgggagacucaucacagcaaacccaguaaucacagaaagcacagaaaacucaaagaugaugcucgaacuugacccacccuucggcgacuccuacaucgucauaggaguaggagagaagaaaauaacccaccacuggcaccgcuccggaaguacaauaggcaaagcauucgaagccaccguccgaggcgcaaaacgcauggcgguccuaggcgacaccgcgugggacuucggaagcgucggcggcgcacucaacucucugggaaaaggcauacaccagauuuucggcgcagccuucaaaucccuauucggcggcaugagcugguucagccaaauacucaucggcacucuccuaauguggcuaggccucaacacgaaaaacggcagcauaagccuaaugugccucgcccuaggaggaguccuaauauuccuaucaacagcagugagcgcu

SEQ ID NO: 2839 - RNA, 2061 nt, Artificial Sequence
  ZIKV (strain ZikaSPH2015) Polyprotein(108-794) CDS opt
accagcgucgggaucgucggccuccuacuaaccacagcaauggcagcagaaguaaccaggcgcgguuccgccuacuauauguaccucgacagaaacgacgcgggcgaagccaucuccuuuccaaccacacucggcaugaacaaaugcuacauccaaauaauggaccucggacacaugugcgacgccacgauguccuacgaaugucccaugcuagacgaaggugucgaaccagacgacguagacugcuggugcaacaccaccagcaccugggugguauacggcacaugccaccacaagaaaggcgaagccagacgaucgcgccgagccgucacgcuccccucccacucgaccagaaaacuacaaacccgcucucagaccuggcucgaaucgcgagaauauaccaaacaccuuauacgagucgaaaacuggauauuccgcaacccaggauuugcauuagccgccgcagcaaucgccuggcuacucgggagcucaacaucacaaaaaguaauuuaccucgucaugauccugcucauugccccagcuuacucaauacgauguaucgggguaagcaaccgagacuuugucgaaggcaugagcggagggaccugggucgacaucguccucgaacacggcggcugcguaacagucauggcccaggauaaacccaccgucgacauugagcuagucacaaccacagucucgaacauggccgaaguacgcagcuacugcuacgaagcguccauaagugacauggccagcgacucccgcugccccacucaaggcgaagccuaccucgauaaacaaagcgacacccaauacguaugcaaaagaacccucgucgaccgaggcuggggcaacgguugcggccuauucggaaaaggcucccuaguuaccugcgcaaaguucgcaugcucaaagaaaaugaccggcaaauccauccaaccagaaaaccuggaauaccgcauaaugcugagcguccacggcucccaacacuccggaaugaucgucaacgacacagggcacgaaacggacgaaaaccgcgcaaaaguugaaauaacccccaauagcccccgcgcagaagcaacacucggcggcuucggaagccuagggcucgacugcgaaccccgcacaggccucgacuucuccgaccuguacuaccuaaccaugaacaacaaacacuggcucguccacaaagaaugguuccacgacaucccacuaccauggcacgcgggugcagacacaggcacaccccacuggaauaacaaagaagcccucguagaguucaaagaugcccacgcaaaaagacagaccgucguaguccucggcagucaagaaggcgccguccacacggcucucgccggagcccuagaagccgaaauggacggagcaaaaggaaggcuauccucaggccaccucaaaugcaggcucaagauggacaaacuaagacucaaaggcguaagcuacagccucugcacagccgcauucaccuucacgaaaauucccgcggaaacgcuacacggcacagugacagucgaaguccaguacgcaggcacagacgggccaugcaaaguacccgcacaaauggcggucgacaugcagacacucacccccguaggaagacuuaucacagcaaaccccguaaucacagaauccacagaaaacagcaaaaugaugcuagaacuagauccacccuucggagacuccuacaucguaauaggcgucggagaaaagaaaaucacucaccauuggcacagaagcggcuccacaauagggaaagccuucgaggcgacaguacgcggagcuaaacgcauggccguacucggggacaccgccugggacuucggcuccgucggcggcgcacuaaacagucucggcaaaggaauacaccaaaucuucggcgccgccuucaaaucccuauucggaggcaugagcugguucagccaaauccugauaggcacauugcucaugugguuaggccucaacaccaaaaacggcagcaucagccucaugugccucgcacucgggggaguacuaauauuccuauccaccgccgucuccgcc

SEQ ID NO: 2840 - RNA, 2061 nt, Artificial Sequence
  ZIKV prME variant CDS opt
accuccguaggcaucgugggacuccuccucacaaccgcaauggccgcagccguaaccagacgcggcuccgcauauuacauguaccucgacagaaacgacgccggcgaagcgaucucguuucccaccacccucgggaugaacaaauguuacauccaaaucauggaccucggccacaugugcgacgccaccaugagcuacgaaugccccaugcuagaugaaggaguagaaccagacgacguagacugcuggugcaacaccacaucaacauggguaguguacggcacaugucaccacaagaaaggugaagcacggcgcagcagacgcgcgguaacgcuccccucacacuccacacgcaaacuccaaaccagaagccaaaccuggcuagaaagccgagaauacaccaaacaccucauacgagucgaaaacuggauauucagaaaccccggauucgcccucgcggccgcggcaauagcuuggcuacucggauccucgaccucacaaaaagucaucuaccuggucaugaucuuacucauagcaccagcauacucgauccgguguaucggcgugucuaaccgcgacuuugucgagggcauguccggcggcaccuggguggacaucguccuagaacacgggggcugcgucaccguuauggcccaagacaaacccacgguagacauagagcucgucaccaccacaguauccaacauggccgaaguccgaucauacugcuacgaagccuccauaagcgacauggccucagacucccgcugccccacacaaggugaagcauaccuagacaaacaaucagacacgcaauacgugugcaaacgcacucuggucgaccgaggcuggggcaacggcugcggccucuucggcaagggaagccuaguaaccugcgccaaauucgccugcucaaagaaaaugaccggcaaaucaauccaacccgaaaaccucgaauaccgaaucaugcuaucaguccacggaucacagcacucuggcaugauagucaacgacacaggucacgaaacagacgaaaaccgcgccaaaguugaaaucacccccaacucaccucgagcagaagccacccucggaggauucggcucccuaggccuagacugcgaaccacgcacaggacuagacuucagcgaccucuauuaccucaccaugaacaacaaacauuggcuaguucacaaagaaugguuccacgacauaccccucccauggcaugccggugcagacaccggaacaccucacuggaacaacaaggaagcccucguagaguucaaggacgcacacgcaaaacgacaaacagucguaguccucggaagccaggaaggagccguucacaccgcacuugcaggagcccuggaagccgaaauggacggugccaaaggccgccuuuccucagggcaccucaaaugccgccucaaaauggacaaacuacgccucaaaggcgucucuuacucccucuguacugccgccuuuaccuucaccaagauaccagcagaaacucugcacggcaccgucacagucgaaguacaauacgcuggcaccgacggacccugcaaaguccccgcccaaauggccgucgacaugcagacccuaacccccguaggaagacuaaucacagccaauccagucaucaccgaauccacagaaaacucaaaaaugaugcucgaacucgauccacccuucggagacagcuacauugucaucggcgucggugaaaagaaaauaacacaccacuggcaucgaucaggcucaacgaucggaaaagcguucgaagcuacaguacgaggcgccaaacggauggccguccucggcgacaccgcuugggacuucggcuccgucggaggugcacucaacucacucggcaaagguauccaccaaaucuucggcgcagcguucaagagccucuucggcggcaugucaugguuuucacaaauacucauaggaacacuacucauguggcucgggcucaacacaaagaacggcagcauaagccucaugugccucgcacuuggcggcguccuaaucuuccuaucgacagcaguguccgcc

SEQ ID NO: 2841 - RNA, 2073 nt, Artificial Sequence
  ZIKV prME variant CDS opt
cgcggcgcggacacaucagucggcaucgucgggcuacuacucacgacggccauggcagccgcugucacaagacgaggaagugccuauuacauguaccucgaccgcaacgacgccggggaagccaucuccuuccccacaacacucggcaugaacaaaugcuacauccaaaucauggaccucggccauaugugcgacgccaccaugucauacgagugcccaaugcuagacgaaggagucgagccagacgacgucgacugcugguguaacacaaccuccacauggguaguuuauggcacgugucaccacaaaaagggcgaagcccgccgaagccgcagagccgucacccuaccuucacacagcacccgcaagcuacaaacacgcagccaaaccuggcuggaaucacgagaauacacaaagcaccuaauacgcgucgagaacuggauauuccgcaaccccggcuucgcacuagcggccgcagcgaucgcauggcuccucggcuccagcacaucgcaaaaggucaucuaccucguaaugauacuccuaaucgcacccgcguauagcauacgguguauaggcgucagcaaccgagacuucguagaaggcaugagcggugguacaugggucgacaucguccucgaacacggaggcugcgucacagucauggcacaagacaagccaacaguagacaucgaacuuguaaccaccaccguuagcaacauggcugaaguuagaucauacugcuacgaagccagcauaagcgacauggccucagacagccgaugcccaacgcaaggagaagccuaccuagacaaacaaucggacacccaauacgucugcaaacgaacccuagucgaccgcggcuggggaaauggaugcggccuauucggaaaaggaucccucgucacaugcgccaaauucgcgugcucaaagaaaaugaccggcaaaagcauacaaccagaaaaccuagaauacagaauaaugcucucaguccacggcagccaacacagcggcaugaucgucaacgacacaggccacgaaaccgacgaaaacagagcaaaagucgagauuacaccuaacaguccacgcgcugaagccacccuaggcggauucggaucgcuaggccucgacugcgaaccacguaccggacuagacuucuccgaccuauacuaccucacaaugaacaacaaacacuggcucguacacaaagaaugguuccacgacauaccccuacccuggcacgccggagcagacaccgggacaccacacuggaacaacaaagaagcccucgucgaguucaaagacgcccacgcaaaacgccaaacagucgucguauugggcucccaagaaggggcaguccacacagcccucgcgggagcccuagaagcagaaauggacggcgccaaaggacgacuaagcuccggccaccuuaagugcagacucaaaauggacaaacugcgacuuaaaggagucucauacucacucugcacagcagcuuucacauucacaaaaauaccagcagaaacccuucacggcacagugacgguagaaguccaguacgccggaaccgacggccccugcaaaguacccgcccaaauggccguagacaugcaaacgcuaaccccaguuggacgucucauaacagcuaacccaguaaucaccgaaucgacugaaaacucgaagaugaugcuagaacucgacccaccauucggcgacagcuacaucguaaucggcgucggcgagaaaaagauaacucaucacuggcaccgcagcgguagcacaaucggcaaagccuucgaagccacgguaaggggagcaaaacgcauggcaguccugggggacaccgcaugggauuucggaucggugggcggggcccuaaacucacugggcaaaggaauccaccagaucuucggcgccgcuuucaaaucacucuucggcggcauguccugguucucacaaauacucaucggaacacuacucauguggcucggacucaacaccaaaaacggaagcauaagccucaugugccucgcacuaggaggaguccucauuuuccucucaaccgccguuuccgca

SEQ ID NO: 2842 - RNA, 2097 nt, Artificial Sequence
  ZIKV prME variant CDS opt
cgcggccugagcagcagaaaacgacgaucacacgacguacucacaguccaauuccucauacucggaaugcuacucaugaccggcggggucacgagaagaggcagcgcauacuacauguauuuagaccgaaacgacgccggcgaagccaucuccuuccccaccacacugggcaugaacaaaugcuacauccaaaucauggaccuaggacacaugugcgacgcgaccaugucauacgaaugcccgaugcucgacgaaggcgucgaaccagacgacgucgauugcuggugcaacaccacauccaccuggguaguauacggcacaugccaccacaagaaaggagaagcccgacgcagccggcgcgcugucacccucccgucacacucuacccgaaagcugcaaacccgaucacagaccuggcuggaaucacgcgaauacacaaaacaccucauccgcgucgaaaacuggauauuccgcaaccccggcuucgcccuagcagcugcagccaucgccuggcuacucggcuccagcaccagccaaaaggucaucuaccucguaaugauccuccucauagccccagcauacucaauccgaugcaucggagugagcaaccgugacuucgucgaaggaauguccggcgggacaugggucgauauugugcucgaacacggaggcugcgucacaguaauggcccaagacaaaccaaccguagacauagagcucguuaccaccaccguauccaacauggccgaagugcgcuccuacugcuacgaagcaagcaucagcgacauggccuccgauucaagaugccccacgcaaggcgaagcauaccuagacaaacaaucagacacacaauacgucugcaaacgaacccucgucgacaggggaugggggaacggcugcggccuuuuugggaaaggaucccuagucaccugugccaaauuugcaugcagcaaaaagaugaccggaaaaucaauucaaccagaaaaccucgaauaccgaauaaugcucucaguccacggcagccagcacagcggaaugaucguaaacgauacaggccacgaaacagacgaaaaccgcgccaaaguagaaauaacacccaacucaccccgcgcagaagccacacuagguggauucgggagccuaggacuagacugcgaaccccgcacaggucuagacuucuccgaccucuacuaccucacaaugaacaacaagcacuggcuaguccacaaagaaugguuccacgacaucccgcuaccauggcacgccggcgccgacaccggaacaccccacuggaacaacaaagaagcccuagucgaguucaaagacgcacacgcaaagagacaaacugucguaguccucggcucccaagaaggcgccguccauaccgcacucgcaggcgcauuagaagccgagauggacggcgcaaaaggacgacuaagcagcggacaccucaaaugccgccuaaaaauggacaaacugagacucaaaggagucucuuacucacucugcaccgccgcauucaccuucacgaaaauccccgccgaaacccuccacgguaccguuaccgucgaaguccaauaugcagggacagacggcccaugcaaaguccccgcccaaauggcagucgacaugcagacccucacgccagucggcagacuaaucacagcaaaccccgucauaaccgaaagcacggaaaacuccaaaaugaugcucgaacuagaucccccauucggcgacucauacaucgucaucggaguaggugagaaaaagaucacccaccacuggcacagaagcggaagcacgaucgguaaagccuucgaagccacuguccgaggugccaaacgcauggcugugcucggagacaccgccugggacuucgggagcgugggcggagcccuaaacagccuagggaaaggcauacaccagaucuucggcgcagcauucaagagcuuauucggcgggaugagcugguucucacaaauccucaucggaacacuccucauguggcuaggacucaacaccaaaaacggaagcauaagucugaugugccucgcccucggaggaguccuuauauuccuauccacagccgucagcgcg

SEQ ID NO: 2843 - RNA, 2097 nt, Artificial Sequence
  ZIKV prME variant CDS opt
agaggccuaucaagccgcaaaagacggucacacgacguauuaacaguacaauucuuaauccuaggcaugcugcuaaugacaggggcaguuacccgccgaggcucagcguacuacauguaccuggaccguaacgacgccggcgaagcaauuagcuucccaaccacacucgggaugaacaaaugcuacauccaaauaauggaccuaggacacaugugcgacgccacaaugucguacgaauguccaaugcuagacgaaggcgucgagccagacgacgucgacugcuggugcaauacaaccagcacaugggucguauacggaaccugccaccacaagaaaggcgaagcccgccgaucccgccgcgcaguaacccuccccagccacagcacccgaaaacuccaaacccggagccaaacauggcuagagagcagggaguacacaaaacaccugaucaggguagagaacuggauauuccgaaaccccggauucgcacucgccgccgcagcuaucgccuggcuacucggauccuccaccucucaaaaggugaucuaucuuguaaugauccuccucauagcacccgccuacucaauacgcugcauaggaguuagcaacagagacuucgucgaaggcaugagcggcggaacaugggucgacaucguccucgagcacggcggaugcgucacagucauggcccaggacaaaccaaccguagacauagagcuaguaacaacaacaguauccaauauggccgaaguccgcuccuacugcuacgaggcaucaaucucagauauggccucagacucgcgauguccaacccaaggggaagccuaccucgacaagcagagcgacacacaguacguauguaaaagaacccuuguugaccgaggcuggggaaacggaugcggccuauuugguaaaggaucacucguaaccugugccaaauucgcaugcuccaagaaaaugaccggcaaaagcauacaacccgagaaccucgaauaccgcauaaugcucagcguacacggcagccaacacagcgggaugauaguaaacgacaccggacacgaaaccgacgaaaaucgagcgaaaguagaaauaacaccaaacagcccaagagccgaagccacccucggcggauucggaagccucggacuagacugcgagccgcgcacagggcucgacuucuccgaccucuacuaccucacaaugaacaacaaacacuggcucguccacaaagaaugguuccacgacauaccacuccccuggcacgccggcgccgauaccggcaccccacacuggaacaacaaagaggcccuggucgaguucaaagacgcgcacgccaagcgccaaacaguggucguacucggaucacaagaaggcgcaguacacacagcccucgccggagcccucgaagccgaaauggacggcgccaaaggacgccuaagcuccggccaccucaagugccgccucaaaauggacaaauugcgacucaagggagucagcuacucacugugcacagccgccuucacauucacaaaaauccccgccgaaacacugcacggaacagucacaguagaaguacaauacgcaggcacugacggaccauguaaaguaccggcgcaaauggcagucgacaugcaaacccucacgccagucggacgacuaaucaccgccaauccagucaucacagaaagcacagaaaacucaaaaaugaugcuagaacuagaucccccauucggagacagcuacaucgugauaggcgucggcgaaaagaaaaucacccaccacuggcaccgaagcggcucaaccauaggcaaagcguucgaagccaccgucagaggcgcuaaacggauggcaguacucggcgacacggcaugggacuucgguucagucgggggcgcgcuaaacagccucggcaaaggaauccaccaaauuuucggggccgcauucaaaagccucuucggcggaaugaguugguucucccaaauacuaaucggcacccuccugauguggcuaggccuaaacaccaaaaacgguucgaucagccucaugugccuagcguugggaggcgugcuaauauuccuaagcacagccguaagugcc

SEQ ID NO: 2844 - RNA, 2136 nt, Artificial Sequence
  KU321639.1 prME-long CDS opt
cgaauaauaaacgcaagaaaggaaaagaaacggcgcggcgcagacacauccgucggaauagugggacuccuacucacaaccgcaauggccgcggaaguaacaagaagaggcucagcguacuacauguaccuagaccgcaacgacgcaggagaagcaauauccuuccccacaacccucggcaugaacaaaugcuacauacagaucauggaccucggacacaugugcgacgcaaccaugagcuacgaaugcccaaugcuagaugaaggcgucgaacccgacgacgucgacugcuggugcaacaccaccuccacguggguagucuauggaaccugccaccacaagaaaggcgaagcccgaagaucaaggagagcagucacacuaccaagccacagcacacgaaaacuacaaacacguucacaaaccuggcucgaauccagagaauacacaaaacaccucauacgagucgaaaacuggauauucagaaaccccggcuucgcccucgcggcagccgcgauagcauggcugcugggaagcaguaccucacaaaaagucauauaccuaguaaugauccuccucaucgcgcccgccuacagcauucgcugcauagguguaagcaaccgggacuucguagaagggaugagcggcgguacaugggucgacaucguacuagaacacgggggcugcguuacaguaauggcacaagauaagcccaccguagacauagaacucgucacaacaaccguaucaaacauggcugaggucagaagcuacugcuacgaagcauccaucuccgacauggcaagugacagucgcugccccacccaaggagaagcguaccucgacaaacaauccgacacccaauacgucugcaaacgaacacucguagaccgcggauggggaaauggcuguggacuuuucggaaaaggcagccuaguaacaugcgccaaguucgccugcagcaagaaaaugacaggcaaaucaauccaaccagaaaaucucgaguaccgcauuauguuaucaguacacggcagccaacacagcggcaugaucgucaacgauaccgggcacgaaaccgacgaaaacagagccaaaguagaaaucacaccaaacagcccaagagcagaagccacacuugggggcuuuggcagccuaggccucgacugcgaaccacgaacaggccucgacuucucagaucuauacuaccucaccaugaacaacaaacacuggcucguacacaaagaaugguuccacgacaucccccuccccuggcaugccggggcagacacgggaacaccccauuggaacaauaaagaagcccuaguagaauuuaaagacgcccacgccaaaagacaaaccgucgucguccucggcagccaagaaggggccguccacaccgcucuagccggggcccucgaagcagagauggacggagccaagggacggcuaagcuccggccaccuaaaaugcagacucaagauggacaaacuaaggcucaagggggucucauacagcuuaugcacagccgcauucacauucaccaaaaucccggcagagacauuacacggcacagucaccgucgaaguacaauacgcaggcacagacggcccaugcaaagucccagcccaaauggcgguagacaugcaaacacucacccccgucggccgccuuaucacagccaacccagucaucaccgaaagcacggaaaacagcaagaugaugcucgaacucgacccacccuucggcgacucguacauaguaaucggagucggagagaaaaagauaacccaucacuggcaccgcagcggcuccaccauaggcaaagccuucgaagcgaccguacgcggcgcaaaacggauggccguacucggcgacacugccugggacuucggaucaguaggcggcgcccucaacucacuaggcaagggaauccaccaaaucuuuggcgcagccuucaaaagccuauucggcggaaugucgugguucagccaaauccucauaggcacguuacucauguggcucggccuaaacaccaaaaacggcuccaucucccuaaugugccucgccuuaggcggaguccugaucuuccucagcacagcaguaucggccgacguaggaugcuccguagacuucagcaaa

SEQ ID NO: 2845 - RNA, 2136 nt, Artificial Sequence
  KU312312.1 prME-long CDS opt
agaauaauaaacgcgcgcaaagaaaagaaacgacgcggcgcagacacaagugucggaaucgucggccuccugcugacgacagccauggcugcagaagucacacgcagaggaagcgccuacuacauguaccuagaccgaaacgacgcaggcgaagccauaucauucccaacaacgcucggcaugaacaaaugcuacauucaaauaauggaccuagggcacacaugcgacgcaacgaugagcuacgaaugccccaugcucgacgaaggagucgaaccagacgacguagacugcuggugcaacacgaccagcacgugggugguauacggaaccugccaccacaagaaaggggaagcacgaagaucacgacgcgccgugacccuccccagucacagcacacgaaaacuccaaacacgcucccaaacauggcuagaaucacgcgaguacacgaaacaccucauccgagucgaaaacuggaucuuuagaaacccaggcuuugcacucgcagcggccgccauugcauggcuacugggcaguagcacaucccagaaaguuauauaccucguaaugauacuucuaauagcgcccgcauacuccauccgcugcauaggaguguccaauagagacuucguagaaggaaugagcggaggcaccuggguagacguagucuuagaacacggaggcugcgucacagucauggcccaagacaaaccgaccguagauauagaacucguaaccaccacagucagcaacauggcagaagugcgaucauacugcuacgaagccucaaucuccgacauggccagcgacagccggugcccaacacaaggagaagccuaccucgacaaacaaucagacacccaauaugucuguaaacgcacacucgucgacagaggguggggaaacggcugcggccucuucggcaaagggucacucgucacgugcgcaaaauucgcaugcagcaagaaaaugacgggcaaauccauccaacccgaaaaccucgaauaccgaauaaugcucagcguccacgggucacaacacagcggaaugauagucaaugacaccggacacgaaacagacgaaaacagagcaaaaguagaaaucacaccaaacucaccgcgagccgaagccacacugggaggauucgggagucucggccucgacugcgaaccccggacuggccuagacuucuccgaccuauacuaccuaacgaugaacaacaaacauuggcucguccacaaagaaugguuccacgacaucccacucccguggcacgccggcgccgacaccggcacuccccacuggaacaacaaagaagcccuugucgaguucaaagacgcccacgcaaaacggcaaacaguaguagucuuagggucacaggagggcgccguucacaccgcccucgcuggggcgcuugaggccgaaauggacggcgccaaaggccgccucuccagcggacaccugaaaugccgacuuaaaauggacaaacuacgacuaaaaggagucuccuacagccucugcacagcagccuucaccuucacgaagaucccagccgaaacacuacacggaacagucacaguagaaguacaauacgcagggaccgacggcccaugcaaaguccccgcccaaauggccguagacaugcagacacuaacgcccguaggaagacucaucacagcaaacccgguaaucaccgaaagcaccgaaaacuccaaaaugaugcuggaacucgaucccccauucggagacagcuacauagucaucggaguaggagaaaagaaaauaacacaccacuggcaccgcagcggaucaaccauaggaaaagccuuugaagccaccguaagaggcgcaaaaaggauggcgguucugggggacacagcaugggacuucggcuccguaggcggcgcacuaaacucccucggcaaaggaauacaccaaaucuucggagcagccuucaaaucucucuucggcggaaugagcugguucagccaaauccuaauaggcacgcuacucauguggcuaggacuaaacgccaagaacggauccaucagccuaaugugccuggcucucggcggcguguuaauauuccuuagcacagcagucuccgccgacguaggcugcagcguagacuucuccaaa

SEQ ID NO: 2846 - RNA, 2124 nt, Artificial Sequence
  AY632535.2 prME-long CDS opt
cgcaucauaaacgcgcgcaaagaacgcaaacgaagaggcgcagauacaagcauaggaauaaucggacuccugcucacaacagcgauggcagcagagaucacacgaagggggucagccuacuacauguaccucgacagguccgacgcaggaaaagcaauaucauucgcaaccacacuaggagucaacaaaugccacguacaaaucauggaccuaggacacaugugcgacgccacaaugucguacgaaugcccgaugcuggacgaaggaguggaaccggacgacguagacugcuggugcaacacaacaaguacguggguggucuacggaacgugccaccacaagaaaggagaagcccgacgaagcagacgagcaguaacacugcccagccauucaacaagaaaauugcaaaccagaucccagacauggcuggaaagcagggaauacaccaaacaccucauaaagguagaaaacuggauauuccgaaaucccggauucgcacucguagccguagcaauagccugguuacugggcucaagcacaagccaaaaaguaauauaccuagugaugauacuccugaucgcccccgcguacucgauccgaugcauaggagucagcaaccgggacuuuguugaagggaugucaggaggaacauggguagacgucgugcucgaacacggaggcugugugacaguaauggcgcaagacaaacccacggucgacauagagcuaguaacaacaacuguaagcaacauggcagaagugagaagcuacugcuacgaagccucgaucucagacauggcaagcgauagccgaugcccuacgcaaggagaagccuaccuggacaaacagucagacacccaguacgucugcaaacggacacuggucgaccgcggcuggggcaacggcugcggccucuucgggaagggaucacucgugaccugcgcaaaguucacgugcagcaagaaaaugaccggcaaaagcauacaaccagaaaaccuagaauaccgaaucaugcucucaguacacggcucgcaacacucaggaaugaucggauacgaaacagacgaagaccgagcaaaaguagaagucacuccaaacagcccgcgcgcagaagcaacacuagggggcuucgggagccucgggcuagacugugaaccacgcacgggacuggacuucagcgaccucuauuaccuaacgaugaacaacaaacacuggcugguccacaaagaaugguuccacgacaucccacuuccguggcacgccggagccgacaccggcacaccccacuggaacaacaaagaagcccuagucgaguucaaggacgcccacgcuaaaagacaaaccgucgucguccucggcucacaagaaggagcgguccacaccgcgcucgcgggcgcucucgaagcggagauggacggugccaaaggacgcuuauucuccgggcaccuaaagugcaggcuaaaaauggacaaauuaagacucaaaggaguauccuacucgcucuguaccgcagccuuuaccuucacaaaggucccagccgaaacccuacacgggacagugacaguugaaguccaguacgccggcacagacggaccaugcaaaaucccgguacagauggcgguagacaugcaaacauugacaccagugggacgccucauaacugcuaacccaguaauaacagaaucaaccgaaaacaguaaaaugaugcuggagcuggacccgccauucggagacagcuacaucgugauaggaguaggagacaagaaaauaacacaccacuggcacaggagcggcagcaccaucggaaaagcauuugaagcgacagucaggggcgcgaaaagaauggcaguacuaggggacaccgcaugggacuuugggagcgugggaggaguuuuuaacagcuuaggaaaaggcauccaccagaucuucggagccgcauucaagagcuuguucggaggcaugagcugguucagccaaauacuaauagggacccuccuggucuggcuugggcugaacaccaaaaacggaagcaucagccugacaugccucgcacuaggaggcguaaugauauuccuaagcacagccgugagcgcggacguggggugcagcguggacuucagcaaa

SEQ ID NO: 2847 - RNA, 2136 nt, Artificial Sequence
  KU527068.1 prME-long CDS opt
cgaaucauaaacgcacggaaagaaaagaagagaagaggagcagacaccagcguagggaucgugggccugcuccucacaacggccauggccgccgaagucacccgcagaggaucagcuuacuacauguaccuagaccgcaaugacgcgggcgaagcaaucagcuuccccacgacccuaggcaugaacaaaugcuacauacaaauaauggacuuaggccacaugugcgacgcaaccaugaguuacgaaugcccgaugcuggacgaaggggucgaaccagacgacguagacuguugguguaacaccacaucaacaugggugguguacgggaccugccaccacaagaaaggcgaagccaggcgaucgagacgagcuguaacccuaccaagccacagcaccagaaaacuacaaacgagaucacaaacguggcuggagucacgcgaauacaccaaacaccucauccgaguugagaacuggauauuccgaaacccggguuucgcauuggcagcggccgccaucgccugguuacucggaagcucuacgagccaaaaggucaucuaccuaguaaugauccuccucauagcaccagcauacagcauccgcuguauuggcgucagcaacagggacuucguagaaggcaugagcgggggcacaugggucgacguaguacuugaacacggcggcugcgucaccguaauggcacaagacaaacccacagucgacaucgaacucguaacaacgaccguaagcaacauggcggaagugcgaagcuacugcuacgaagcaucaaucagcgacauggcgagcgacagcagaugcccuacccagggcgaagcauaccucgacaaacaaagcgacacacaauacguaugcaagagaacucuagucgaccgaggguggggcaacggaugcggacuauucggaaaaggcagccucgucacaugugcaaaauucgccugcucaaagaaaaugacagguaaaagcauacaacccgaaaaccuggaguaccgcauaaugcuaagcguacacgggucccaacacagcggcaugauagucaacgacaccggacacgagacagacgaaaaccgagccaaaguggaaauaaccccaaacagcccaagggcagaggccacccuaggaggguucggcagccucggccucgacugcgaaccacgcaccggccuagacuucucagaccuauacuaccucacaaugaacaacaagcacuggcucguacacaaagaaugguuccacgacaucccccuuccauggcacgcgggagccgacaccggaacgccccacuggaacaacaaggaagcgcucguggaguucaaagacgcccacgcaaaacgacaaaccgugguaguccuaggaagccaagaaggggcaguacacaccgcacucgccggagcacuagaagcggaaauggacggagcgaaagggagacucagcagcggacaccugaaaugucgacucaaaauggacaagcuacggcugaagggagugagcuauucccucugcacagcagccuucacauucacaaaaaucccggccgaaacacuacacggaaccgucacuguggagguacaauacgccggcacagacggccccugcaagguaccagcccaaauggcaguagacaugcaaacacucacaccagugggccgccuaauaacggcaaauccaguuauaaccgagagcacggaaaacuccaagaugaugcucgaacucgaucccccguucggagacucauacauaguaauaggcguaggggagaaaaagaucacccaccacuggcacagauccggcucgacaauaggaaaagccuucgaagccaccguacgcggagcaaaaagaauggcgguacuaggagacacagcaugggacuucggauccgugggcggagcccuaaacucccucggaaagggaauacaccagauauucggagcggcauucaaaucccuauucggaggaaugagcugguucagccagauccucauaggaacacuacuaauguggcuaggucucaacaccaaaaacggaagcauuagccucaugugccucgcacuaggcgguguacuaauuuuccuaagcacagccguaucagcggacguaggaugcagcguagacuucuccaag

SEQ ID NO: 2848 - RNA, 2136 nt, Artificial Sequence
  KU720415.1 prME-long CDS opt
cggaucauaaacgccaggaaagaacgaaaacggagaggagcagacacgagcauuggcaucaucgggcuacuacuaacgaccgcgauggcggcggagaucacacgaagaggaagcgcauacuacauguaccuggacagguccgacgccggaaaagccauuucauuugccacaacacuagggguaaauaagugccacguacaaauaauggaucuuggacacaugugcgacgcaacaauguccuacgaaugcccaaugcuggaugagggcguagaaccagacgacgucgacugcuggugcaacacgacaucgacgugggucguauacggaacaugccaccacaagaagggggaagcacgaagaucgcggagagcaguaacacucccgagucacucgacacggaagcuacaaacaaggagccaaacauggcuggaguccagagaauacacaaagcaccuaauaaaagucgaaaacuggaucuuccgcaaccccgguuuugcccuagucgcagucgcaauagccuggcuacuaggcucaagcaccagccagaaaguaauauaucuagugaugauacuccugauagcgccagcguacagcauuaggugcauaggaguaagcaaccgcgacuucguagaaggcaugucgggcgggaccugggucgacgucguauuagaacacggaggcugcgucaccguaauggcacaggacaaaccaacaguagacaucgaacucguaaccaccacagucagcaacauggcggaggucagaagcuacuguuacgaggcaucuauaagugacauggccagugacagccgcuguccaacacaaggagaagcauaccuagacaaacaaucagacacacaauacgucugcaagagaacccuaguagaccggggaugggggaacgggugcggacuuuucggcaagggcucgcucguaacaugcgcaaaauucacgugcucgaagaaaaugacgggcaaaagcauccaaccagaaaaccucgaauacaggauaaugcuaucggugcacggcucacaacacucaggaaugauaguaaacgacaccggauaugaaacagacgaaaaccgggcaaagguagagguaacaccgaacagcccccgggcagaggcgacacuaggcggcuucggaagccuaggcuuagacugcgaaccaagaacaggccucgacuucucagaccucuacuaccuaaccaugaacaacaaacacuggcucguccacaaagagugguuccacgacauaccgcucccauggcacgcgggagccgacacaggaacaccgcacuggaacaacaaagaggcccuaguagaguucaaagacgcacacgcaaaaagacaaacaguaguagugcuaggcagccaagaaggcgccgugcacacagcccucgccggagcgcuggaagccgaaauggacggcgcgaaaggcaaacuguucuccggacaccuaaagugccggcucaaaauggacaagcugcgacucaagggcguaagcuacucccuguguacagcagccuucacauucacaaaagugccggccgagacccuacacgggaccgugacaguagaagugcaauacgccggaacagacggccccugcaagaucccgguacaaauggcagucgauaugcaaacacuaacacccgucgggagauugauaaccgcaaaccccguaauaacagaaaguacagagaacaguaaaaugaugcuagaacuggacccgcccuucggcgacagcuacauagucaucggcgucggagauaagaaaaucacacaccacuggcaccgaagcgggagcacaauagggaaagcguucgaggcaacagucaggggagcgaaacggauggccguacuaggcgauaccgcgugggacuucggaagugucggcggcguauucaacucacuagggaaaggaauccaccaaaucuucggagcagccuucaagagccuauucggcggcaugaguugguucucacaaauacugauaggcacacugcugguauggcuagggcuaaauaccaaaaacgggagcauaagccuaaccugccucgcacucgguggcgugaugaucuuccugagcacagccguaagcgcggacguagggugcagcguggacuuuagcaaa

SEQ ID NO: 2849 - RNA, 2118 nt, Artificial Sequence
  DQ859059.1 prME-long CDS opt
agaaucaucaacgccaggaaagagcgaaaacgucguggagcagacacaucgauaggcauagucggccuacugcucacaaccgcaauggccgcagagauaacacgcagaggcucagcauacuacauguaccucgaccgaagugacgccggaaaagcaaucucauucgcaacaacacuaggcguaaacaaaugccacguacaaauuauggaccuaggucacaugugcgacgccaccaugucauacgagugcccgaugcuagacgaaggcguggaaccagacgacguagacugcuggugcaacacaacgagcaccugggucguauacgggacgugccaccacaagaaaggcgaagcaagacgaagccggcgcgccgugacacucccaagccacagcacccgaaaacuacagaccagaagccagacuuggcuagaaagccgagaauacaccaaacaccucaucaaaguagaaaacuggaucuucagaaacccaggguucacgcucguagccguagccauagccuggcucuuaggcucaagcacgucgcaaaaagucaucuaccuagugaugauacuccugauagcgcccgccuacagcauacgaugcaucggagucagcaaccgcgacuucguggagggcaugucaggagggaccugggucgacguaguccuggaacacggaggcuguguaacaguaauggcccaggacaaaccaacagucgacaucgaacucguaaccaccaccguguccaacauggcagaagucagaucuuacugcuacgaagccagcaucucagacauggccucagacucacgcugucccacacaaggagaagcguacuuagacaaacaaucagacacccaauacguaugcaaacgcacgcucgucgaucgagguuggggaaacggcugcggacuauucggcaaaggcucgcucguaaccugugcaaaauucacaugcagcaagaaaaugacaggcaaaagcauccaaccggaaaaccuagaauaccggaucaugcucucgguacacggcucccaacacagcggaaugauagucaacgacgagaaccgcgcaaaaguagaagucaccccaaacucuccccgcgcagaagcaacccuaggaggguucggaucccuaggcuuggacugcgaacccagaacaggacucgacuucagcgaccucuacuaccuaacaaugaacaacaagcacugguugguucacaaagaaugguuccacgacaucccucucccauggcaugcgggggcagacacagggacgccucacuggaacaacaaagaagcccuagucgaguucaaagacgcgcacgcaaaacgccaaacggucguaguacucggcagccaagaaggcgcgguccacaccgcgcuagccggcgcucucgaagcggaaauggacggagcaaaaggacgccuauucuccggccaccucaagugccgacuaaagauggacaaacuacgauugaaagggguauccuauucccucugcacagcagcauucaccuucaccaagguccccgccgaaacccuacacggcaccgucaccgucgaagugcaauacgcaggaaccgacggcccgugcaaaguccccgcacaaauggccgucgauaugcagacacuaacaccgguaggacgacugaucacugcgaaccccgugaucaccgaaagcaccgaaaacucaaaaaugaugcucgaacuagacccuccguucggcgacagcuacaucgucaucggggucggcgacaagaaaauaacccaccacuggcaccgcagcggaucaacuaucggcaaagcguucgaggccaccguaagaggcgccaaacggauggcaguacuaggcgauacagcaugggauuucggguccguaggaggcgucuucaacagccucggaaaaggcauccaccaaauauucggcgccgcguucaagagccuauuuggcggaaugagcugguucucacaaauccugaucggaacucuccuagucuggcuaggacuaaacacgaaaaauggaucaauaagccuaacaugccuggcacuaggaggcgucaugauauuccuaaguacagcagucagcgccgacgucggaugcagcguagacuucagcaaa

SEQ ID NO: 2850 - RNA, 2136 nt, Artificial Sequence
  KX377335.1 prME-long CDS opt
cgcaucauaaacgcgagaaaagaacgaaaacgccgcggggcggacacgagcaucggcauaaucggacuguugcuaacgaccgcgauggccgcggagaucacaagacgaggcagcgcguacuauauguaccucgaccgguccgacgccggaaaagccaucucguucgccaccacccuaggagucaacaaaugccacguccaaauaauggaccucggccacaugugcgaugccacaaugucauacgagugccccaugcuagacgaagguguagaaccagacgacguagacugcuggugcaauaccacgagcacguggguaguuuacggcacgugucacagaaagaaaggagaagccaggagaucaagacgcgcggucacccucccaagccacucaacacgcaaauuacagaccagaagccagaccuggcucgaguccagagaauacaccaaacaccugauaaaagucgaaaacuggaucuuucgcaaccccggauucgcacucguggcaguagcgauagcauggcuccuaggcagcagcacaucccaaaaagugauuuaucucgucaugauccuacugauagcaccggcguacagcaucaggugcauaggaguaaguaacagggauuuuguagaaggcaugucuggcggaacguggguagacgucguacucgagcacggaggcugugucacagucauggcccaagacaaacccacagucgacaucgagcucgucaccacgacagucagcaacauggcagaagugcgaucauacugcuacgaagcgucgaucagcgacauggcauccgacucgcgcugccccacgcaaggugaagcauaccuagacaagcaaucagacacacaauaugucugcaaacgcacccucgucgaccgaggauggggcaacggaugcggacucuuuggaaaaggaucccuaguaaccugcgccaaauuuaccugcagcaaaaagaugacgggcaagagcauccaacccgaaaaccucgaguacagaaucaugcuguccguccacggcucgcaacacucaggaaugauagucaacgacacaggcuacgaaacagaugaaaacagggcaaaagucgaagucacccccaacuccccacgcgcggaagccacccugggcggauucggcucccuaggccuagacugcgaaccacgcacaggacucgacuucagcgaccuguacuaccuaacaaugaacaacaaacacuggcuaguccacaaggagugguuccacgacauaccacuccccuggcacgcaggcgccgacaccggaaccccgcacuggaacaacaaagaagcacucgucgaguucaaagacgcacacgcaaagagacaaacgguaguaguccugggaucccaagaaggcgcaguacacacagcacuggccggcgcccuagaagccgaaauggacggcgcgaaaggaaaacuguucagcggccaccucaaaugccgccuaaaaauggacaaacuacgacucaaaggaguaucuuacucccuauguaccgcagccuucaccuucaccaaaguaccggccgaaacgcuccacggaacugugacagucgagguacaauacgccggcaccgacggacccugcaaaauaccaguacaaauggccguagacaugcaaacgcuaacgcccguaggacggcuaaucacagcgaaccccgugauaacagaaucaaccgagaacucaaaaaugaugcucgaacuagacccgcccuucggcgacagcuauauagugauaggcguaggcgacaagaaaauaacccaccacuggcacagaagcggauccaccaucggcaaagcguucgaagcaaccguaaggggcgccaaaagaauggcaguccuaggagauaccgccugggacuucggaagcgucggaggagucuucaacagccuuggaaaagggauucaccaaaucuucggagccgccuucaaaagccuauucgggggcauguccugguucagccaaauacuaaucggcacccuauuagucuggcucggccucaauaccaaaaauggcagcauuagccuaaccugccuagcacucggaggcgucaugaucuuccugagcacagccguaagcgccgacguaggcugcuccguagacuucuccaaa

SEQ ID NO: 2851 - RNA, 2136 nt, Artificial Sequence
  LC002520.1 prME-long CDS opt
cgcauaaucaacgccagaaaagaacggaaacgacgaggcgcggacacaucaauaggaaucauaggacugcugcugacaacagcgauggcggccgagauaacaagacgaggcucggccuacuacauguaccucgaccggagcgacgcagggaaagcgauaucauucgcaacgacacucggaguaaacaagugccacguacaaaucauggaccucggacacaugugcgacgccacgaugucauacgagugccccaugcuggacgagggcgucgaaccagacgacguagacugcuggugcaacaccacaagcacauggguaguauacggaaccugccaccacaagaaaggcgaagcgcgaaggucaagacgagcagucacccuaccaagccacagcacaagaaaacuccaaacccgcucacaaaccuggcuagaaagccgagaauauaccaaacaccucaucaaaguagaaaacuggauauuccgcaacccaggcuucgcacucguggcaguagccauagcaugguuauuaggcaguagcacuagccaaaagguaaucuaccuagucaugauacuccuaaucgcgcccgcguacucaaucagaugcaucggaguaagcaacagagacuucguagaagggaugucagggggaacauggguagacgucguacuagaacacggaggaugcgucacgguaauggcccaggacaagccaaccgucgacauagagcucgugaccacuaccguaagcaacauggcggaaguacgaucauauugcuacgaagccucaauaucagacauggccucugacagccgcugcccaacacaaggagaagcguaccuagacaagcaaagcgacacgcaauacgucugcaaacggacacucguagaccgcggauggggaaacggcugcggucuauucggaaagggcucgcucguaaccugcgcaaaauuuaccugcucaaagaaaaugacaggcaaaucaauucagccggaaaaccucgaguacaggaucaugcucuccguacacggcucacaacauagcggcaugacagucaacgacauaggauacgaaacugacgaaaacagggccaaagucgaaguaacgcccaacagcccaagagcagaagccacacugggaggauucggcagcuuaggccuggacugcgaaccgcgaaccggauuggacuucucagaccucuacuaccuaaccaugaacaacaaacacuggcuaguccacaaagaaugguuccacgacauaccacuaccguggcacgcaggcgcagacaccgggaccccgcacuggaacaacaaagaagcgcuggucgaguucaaagacgcgcaugccaaacgacaaaccgucguggucuuaggaucccaagaaggcgcgguccacacggcacuggcaggcgcucucgaagccgaaauggacggagcaaaaggaaagcuauucagcggccaccucaaaugcagacucaaaauggauaaacugaggcucaaagggguaucguacucccugugcacagcagccuucaccuucacaaaaguccccgcagagacccuccacggcacagugacaguggaaguccaauacgccgggacagacggaccaugcaaaaucccaguccagauggcaguagauaugcaaacacugacacccguaggaagacuaaucacggcaaaccccgugauaacagaaucgacagaaaacuccaaaaugaugcuggaauuagacccacccuucggcgauagcuacaucguaauaggagucggggacaagaaaauaacacaccacuggcaccgcagcggaagcaccaucggcaaagcauucgaggcgacggucagaggcgcaaaacgaauggcggucuuaggagacacagcaugggacuucggguccgugggagggguguucaacucacuaggaaaaggaauccaucaaaucuucggagccgcauucaaaagccuauucggagggauguccugguucucacaaauacuaauaggcacacugcugguauggcuaggacucaacaccaaaaacgggagcauaagccuaaccugccucgcacuagggggaguuaugaucuucuugagcacggccgucagcgcagacgucggcugcucaguagacuucagcaaa

SEQ ID NO: 2852 - RNA, 2124 nt, Artificial Sequence
  KU963573.2 prME-long CDS opt
cgcauaaucaacgcccgcaaagaacgcaaacgaagaggcgcagacacaagcauaggcaucaucggccuccuccucacaaccgccauggcagcagaaauaacccgcagaggaagcgccuacuacauguaccuagaccgcuccgacgcaggcaaagccauaucauucgcaacaacccugggaguaaacaaaugccacguccaaauaauggaccugggccacaugugcgacgccacgauguccuacgaaugcccaauguuagacgaaggaguagaacccgacgacgucgacugcugguguaacacaacuagcacauggguagucuauggaaccugccaccacaagaaaggagaagcaagacgaucccgccgcgcggugacccugccaagccacucaacacgaaaacuacaaaccagaucccaaaccuggcucgaaucacgugaauacaccaaacaccucauaaaggucgagaauuggauauuccgaaacccaggcuucgcccuaguagcaguagcaauagcauggcugcucgggaguagcaccagccaaaaggucaucuaccuagucaugauacuacucauagccccagcauacagcauccgaugcauaggaguauccaaccgcgacuucguagaagggaugagcggaggcaccuggguagacguaguccucgaacauggaggaugcguaacgguaauggcacaggacaagcccacggucgacauagaauuagugacgaccacaguauccaacauggccgagguacgaaguuacugcuacgaagcgucaauauccgacauggcgagugacucgcgcugccccacacaaggggaggcuuaccucgacaaacagagcgacacacaauacgucugcaaacgaacccuagucgaccgcggaugggguaacggcugcggacuauuuggcaaaggcagccuagugaccugcgccaaauucacauguuccaaaaagaugacuggaaaauccauacaaccagaaaaccucgaauaccgcaucaugcuauccguacacggcucacaacauucaggcaugauaggguacgaaacagacgaaaaccgcgccaaaguagaagucacaccaaacagcccaagagcagaggccacacuaggaggcuucggaucccucggacucgacugcgagccgcgaaccggccucgacuucucggaccuauacuaccucacaaugaacaacaaacacuggcucguccacaaagaaugguuccacgacaucccccugccauggcacgcaggcgcagacaccggaacaccgcacuggaacaacaaagaagcacugguagaguucaaagacgcccaugccaaacgccaaacaguaguaguucugggaucccaagaaggcgcaguccacacugcccucgcgggcgcccucgaagcagaaauggacggcgcuaaaggcaaacuauucuccgggcaccucaaaugucgacuaaaaauggacaaacuccgacuaaaaggcguaagcuacucucucugcaccgccgcguucacguucacaaaaguccccgccgaaacacuccacggcacagucaccgucgaaguccaauacgccggaaccgacggacccugcaaaauacccgugcagauggcaguagacaugcaaaccuuaacaccagucggacgccucauaaccgcaaacccagucaucacagaaagcaccgaaaacuccaaaaugaugcuagaacucgacccgcccuucggcgacuccuacaucgugauaggcgugggggacaagaaaaucacacaccacuggcaccgaagcggcagcacaaucggaaaagccuucgaggccacagucagaggcgcaaaaagaauggccgugcuaggagacaccgcaugggacuucgguuccguaggcggcguauucaacagccucggcaagggaauccaccaaaucuucggcgcggcuuucaaaagccucuucggcggcauguccugguucucacagauccugaucggcacacuccucgucuggcuaggccuaaacaccaaaaacggcucgauaaguuuaacaugccucgcacugggcggagucaugaucuuccucucaaccgcaguuagcgccgacguaggaugcagcguagauuucuccaaa

SEQ ID NO: 2853 - RNA, 2136 nt, Artificial Sequence
  KX694534.2 prME-long CDS opt
agaaucaucaacgcacgaaaggaaaagaaacgcagaggagcagacacaagcgucggcauaguaggacuccuacuaacaacagccauggccgcagaagucacaagaaggggaagcgcauauuacauguaccucgaccgcaacgacgcuggcgaagccaucagcuucccgaccacccuaggcaugaacaaaugcuauauacaaauaauggaccucggccauaugugcgacgcaacaaugagcuacgaaugccccaugcucgacgaaggcgucgaaccagacgacgucgacugcuggugcaacacaaccucaacaugggucgucuacggcacgugccaccacaaaaagggagaagccagacgcucccgacgagccguuacccucccuagccacagcacgagaaaacuccaaacacgaucacaaaccuggcuugaaagccgcgaauacaccaaacaccucauccgcguggaaaacuggauauuccgaaaucccggcuucgcccucgcagcagccgcgaucgcauggcuccuuggcuccuccacgucccagaaagucaucuaucucgucaugauccuacuuaucgcgccugcauacuccauaagaugcaucggcguaagcaacagagacuucgucgaaggcauguccggcggcaccugggucgacgucguccuagaacacggggguugcguaaccgucauggcucaggacaaaccaacagucgacaucgaacugguaacaacgaccgucagcaacauggccgaaguacgcagcuacugcuaugaggcuucaauaagcgacauggccagcgacagccggugcccaacacaaggagaagccuaccuagacaaacaaucagacacccaauacgucuguaagagaacccugguggaccgcggauggggaaacggcugcggauuguucggcaagggcucccuaguaacaugcgcaaaauucgccugcuccaagaaaaugaccggcaaaucgauccaacccgaaaaccucgaauaccgcauaaugcuauccguccacggcucacaacacucaggcaugauaguaaacgacaccggacacgaaacagacgaaaauagagcgaaaguggagaucacucccaacagcccaagagcggaagccacacuaggaggcuucggcucccuaggacucgacugugaaccacgaaccggacucgauuucucggaccucuacuaccuaacaaugaacaacaaacacuggcucgugcacaaagaaugguuccacgacauaccccucccuuggcacgcaggagcagacaccggcaccccacacuggaacaacaaagaagcccucguagaguucaaagacgcccacgccaaaagacaaacaguuguaguacugggcagccaagaaggagccgugcacaccgcccuagccggagcccuagaagccgaaauggacggggcuaaaggccguuuauccagcggccaccuaaaaugcagacuaaaaauggacaaacuaagguuaaaaggcguaagcuacucccuaugcacggcggcauucaccuucacaaaaauccccgcagaaacccuccacggaacagucacaguggaaguucaauacgccggcacagacggacccuguaagguaccagcacaaauggcugucgacaugcagacucugacaccaguugggcgacucaucaccgcaaaccccgucaucacugaaagcaccgaaaacuccaagaugaugcuagaacuugacccaccauucggagacagcuacauaguaauuggcgucggcgaaaagaaaaucacacaccacuggcacagaagcggcagcacgauagguaaagcauucgaagcaaccguaaggggcgccaaacgaauggcagugcucggagacaccgccugggacuucggaagcguaggaggcgcccugaacucacuaggccgaggcauacaucaaauauucggggcagcauucaaaagccucuucggcggcaugagcugguucagucaaauacuaauagggacacugcuaauguggcuaggacugaacaccaaaaacggcucaauaucacuaaugugccuagcacucggaggcgugcuaauauuccuaagcacagcagucucggcagacguaggaugcagcguagacuucuccaaa

SEQ ID NO: 2854 - RNA, 2136 nt, Artificial Sequence
  KX447520.1 prME-long CDS opt
cgcaucaucaacgcaaggaaggagaaaaagcgacgaggcgcagacgcgagcgucggcauaguaggccuccugcucacaaccgcgauggccgccgaggucacacgcagaggcucggccuauuacauguaccucgacagaaaugacgcaggcgaagccaucucauucccgaccacacucggaaugaacaaauguuacauacaaaucauggaccuagggcacaugugcgacgcaacuauguccuacgaaugcccgaugcucgacgaaggaguagaaccagacgacguagauugcuggugcaacacaacaagcacauggguagucuauggcacgugccaccacaaaaagggggaggcgaggaggagcagaagggcaguuacacucccaagccacagcacgcgcaaacuacaaacaaggagccagaccuggcuugaaagcagagaauacacaaagcaccugaucagggucgaaaacuggauauuccgcaacccggguuucgcacuagcagcagcagcaaucgcauggcuccuaggaagcagcacgucccaaaaaguaauauaccucguaaugauacugcucaucgccccagcuuauucaaucaggugcaucggcgugagcaacagagacuuuguggaaggaaugucaggcggcacgugggucgacgucguucuagaacacggaggaugcgucacaguaauggcucaggacaaaccaacagucgacauagagcuaguaacaacaaccguaagcaacauggcagaaguucgcaguuacugcuaugaagccucgaucucagacauggccucagacucgagaugccccacacaaggagaagcguaccuagacaaacaaucagacacccaauacguaugcaaaaggacccuaguagaccgcggaugggggaacgggugcggacuauucggaaagggaucgcucguaaccugcgcaaaauucgccugcagcaaaaagaugacuggcaaaagcauacaacccgaaaaccuggaauacagaaucaugcuaucaguccacgggagccaacacucaggcaugauaguaaacgacacgggccacgaaacagacgaaaacagagcuaaaguagagauaacacccaacagcccacgagcggaagcgacacuaggagguuucggaagccuaggccuggacugcgaaccgcgaacaggccucgauuucagcgaucucuacuaccugaccaugaauaacaaacacuggcucguacauaaagagugguuccacgacauaccgcuaccauggcaugccggagcagacaccggaacaccccacuggaacaacaaagaggcccuagucgaguucaaagacgcgcacgccaaaagacaaacaguggugguacugggaucgcaggagggcgcgguccacacugcacucgccggcgcgcuagaagccgagauggacggagcaaaaggacgccuaagcagcggacaccucaagugccgacuaaagauggacaagcuccgccuaaaaggggucucguacagucucugcacggcagcauucaccuucacgaagaucccggcggaaacacugcacggaaccguaacaguagaagugcaauacgccgggaccgacggcccgugcaaagucccggcccaaauggcaguagacaugcaaacgcuaacaccaguaggaagacugaucacugccaacccaguaaucacagaaucgacagagaacucaaaaaugaugcuagaauuggacccgcccuuuggcgacagcuacaucgugauaggaguaggggaaaagaaaauaacacaccacuggcaccgaagcggaagcacaaucgggaaagccuucgaggcaacaguccgaggcgcaaagagaauggcaguccuuggagacacggcaugggacuucggaagcgucgggggcgccuugaacucacuaggcaaagggauccaccaaauauucggagccgcguucaagagccucuucggcggcauguccugguuuucacaaauacucaucggaacauuacugauguggcucgggcuuaacaccaagaacggcucaauaagccugaugugccucgcccuagggggcguacucauauuccuguccacggccgucagcgccgacguaggaugcagcguagauuucagcaaa

SEQ ID NO: 2855 - RNA, 2136 nt, Artificial Sequence
  KX369547.1 prME-long CDS opt
cgaaucaucaaugcacggaaagagaaaaagcgccgaggggccgacacgagcgucgggaucguaggccuacugcugaccaccgcaauggccgcagaagucacacgacgaggcagcgcauacuacauguaccucgacagaaacgacgccggagaagccaucucauuccccacaacacucgggaugaacaaaugcuacauccaaauaauggaccuaggacacaugugcgaugcaaccaugagcuacgaaugcccaaugcucgaugaaggcguugaaccagacgacguggacugcuggugcaacacaacuagcaccugggucgucuacggcacaugccaccacaagaaaggggaggcacgcagaagucgacgggccguaaccuuacccagccacuccacaagaaaacuacaaacacgcucacaaaccuggcuggaaagucgagaauacaccaaacaccucauccgaguggaaaacuggaucuucagaaacccgggacuagcacuagccgccgcagcaaucgcauggcuacuaggaagcuccacaagccaaaaagucauauaccucgucaugauccuacugaucgccccagcauacaguauacgcugcauaggagugagcaacagagacuucguagaaggcaugucaggaggaacgugggucgacguaguccucgagcacggcggcugcguaaccguaauggcacaagacaaacccaccguagacauagaacucgucaccacaaccguuagcaacauggcagaggucaggucuuacugcuacgaagcaagcauaagcgacauggcauccgacucaagaugccccacccaaggcgaagcauaccuagacaaacaauccgacacacaauacguaugcaaacgaacccuaguagaccggggcuggggcaacggcugcggacuauucggcaaagggagccuagucacaugcgcaaaauucgcauguuccaagaaaaugaccggcaaauccauccaaccagagaaccucgaguaccgcauaaugcugucaguacacggcucccaacacuccggaaugauagugaacgacaccggccacgaaaccgacgagaacagagccaaagucgaaauaacacccaacucaccccgggcagaggcaacccucggaggcuucggcagucucggacucgacugcgaaccccguaccggucucgacuuuucagaccuauacuaccuuacuaugaacaacaaacacuggcuagugcacaaagagugguuccacgauaucccccuaccauggcacgccggggccgacaccggcacaccacacuggaacaacaaagaagcgcucgucgaguucaaagacgcgcacgcaaagcgccaaaccgugguaguccuaggcagccaagaaggggcaguccacacagcacuagccggagcgcuggaagcagaaauggacggagccaaaggccgccuauccagcggacaucuaaaaugcagacuaaaaauggacaaacuccgucucaaaggaguauccuacagccucugcacagcagcuuucaccuucacgaagauccccgccgaaacccuccacggcacagucacagucgaaguccaguaugccggaacagacggaccaugcaaagugccggcccaaauggccguggacaugcaaacacuuaccccaguaggccggcuaaucacagcaaacccagugaucaccgaaagcaccgaaaacuccaaaaugauguuagaacuggacccacccuucggcgauuccuacaucgucaucggcgugggcgaaaagaaaaucacacaccauuggcaccgaagcggcuccaccaucggaaaggcauucgaagccaccguaagaggcgccaagcgcauggcaguacuaggagacacagcgugggacuucggcagcgucggaggagcucuaaacagccugggaaaggguauacaccaaaucuucggagcggccuucaaaagccucuucgggggcaugucaugguucagccagauccuaaucggaacccuacuaauguggcucggccuaaacaccaagaacggaagcauaucgcugaugugcuuagcacucggcggaguacuuaucuuccucucaacagccguauccgccgacgucggcugcagcgucgacuucagcaaa

SEQ ID NO: 2856 - RNA, 2136 nt, Artificial Sequence
  KX447515.1 prME-long CDS opt
cggaucaucaacgcacgcaaagagaagaaacgacggggagccgacaccucaguaggcaucgugggacuacuucucacaacggcaauggcagccgaaguaacacgcagaggaagcgccuacuacauguaccuagaccgcaacgacgccggcgaagcaaucagcuuccccacaacccuaggaaugaacaaaugcuacauacaaauaauggaccucggccacaugugcgacgccacaaugucauacgaaugccccaugcuagacgaaggaguagaacccgacgacgucgacugcuggugcaacacgacaagcaccuggguuguauacggaaccugccaccacaagaaaggcgaagcacgccgcucacggagagccguaacccuccccucacacagcacaagaaaacugcaaacacggucgcaaaccuggcuagaaucacgcgaauacaccaaacacuuaauccgagucgaaaacuggauauuccgcaauccaggcuucgcacucgccgcagccgccaucgcauggcuacugggaagcuccacaagccaaaaaguuaucuaccucguaaugauccuacuaaucgcccccgcuuacucgauacggugcauaggaguaucgaacagggacuucguagagggcauguccggcggcacaugggucgacgucgucuuagagcacgggggcugcguaaccgucauggcucaagacaaaccgaccguggacaucgaacucguaaccacaaccgugagcaacauggccgaaguaagaagcuauuguuacgaagcaagcaucucagacauggcaagcgacagcagaugcccaacccagggagaagcauaccuagacaaacaaucagauacacaauacgugugcaaaaggacacucguagacagaggaugggggaacggaugcgggcuuuucggaaaaggaucacucgucacaugcgcaaaauucgcaugcagcaagaaaaugacaggcaaaucaauccaacccgagaaccuggaauacagaauaaugcuauccguccacgggagccaacacuccggaaugauaguaaacgacacaggacacgaaacugacgagaaccgagccaaagucgagaucacaccaaacagcccacgcgcggaagccacacucggcggauucggaucccucggccucgacugcgagccacgaaccggccuagacuucucggaccuauacuaccuaaccaugaacaacaaacacuggcuggugcacaaagaaugguuccaugacauaccgcuuccauggcacgcaggagcagacaccggcacaccccacuggaacaacaaagaagcgcuuguugaguucaaagacgcccacgccaaaagacaaaccguaguaguacucggcagccaagaaggugccguacacacagcgcuugccggcgcccucgaagcagaaauggacggcgcaaaaggacgccuuagcagcggccaccuaaaauguaggcucaaaauggacaaacuaagacuaaaaggggucuccuauucccuaugcacggcagcauucaccuucacgaaaauccccgcagaaacccuccacggaaccguaacagucgaaguacaguacgcaggaaccgacggaccgugcaaagucccagcccagauggcaguggacaugcaaacccugacgccagucggccgacucaucaccgccaacccugugaucacggagagcacagaaaacagcaaaaugaugcucgaacucgacccacccuucggcgacucguacauagucauaggcguaggcgaaaagaaaauaacacaccacugguaccgcuccggcagcacaaucgggaaagcauucgaagccacagucagaggggcgaaacgcauggccguacuaggagacacagccugggacuucggcagcguaggaggcgcacuaaacagccuagggaaaggcauacaccaaaucuucggagccgccuucaaaagccuauucgguggaauguccugguucucccaaauacuaauaggcacacuccuaauguggcucggacuaaacaccaaaaacggaucaaucucccuaaugugucucgcccuaggcggaguacucauauuucuauccacagcagucagcgcagacguaggguguucagucgacuuuagcaaa

SEQ ID NO: 2857 - RNA, 2136 nt, Artificial Sequence
  KU501217.1 prME-long CDS opt
cgaaucauaaacgcccggaaagaaaagaaacgccgcggagccgacaccuccgucggaauaguaggccugcugcucaccacggccauggcugccgaagugacccgccgaggaagugccuacuacauguaccucgacagaaacgacgcaggcgaagcaaucagcuuccccacaacguuaggcaugaacaaaugcuauauacagauaauggaccugggccauaugugugaugcaaccaugucauacgaaugccccaugcucgacgaaggagucgaaccagacgacguagauugcuggugcaacacaaccucgacauggguagucuauggaacaugccaccacaagaaaggcgaagcccgccgcucaagacgagcgguaacgcuaccuucgcauuccacacgaaaacuacaaacccgcucccaaacauggcuagaaagccgagaauacacaaaacaccucaucaggguagagaacuggaucuuccgcaacccaggcuucgcacucgccgcagcagccaucgccuggcuacuaggaagcagcacaucgcaaaaaguuaucuaccucguaaugauccuccuuaucgccccggccuacagcauacgcugcaucggggucuccaacagagacuucgucgaaggcaugagugggggcacguggguagacgucguacuagaacacggcggaugcgugaccgucauggcacaagacaaacccaccguggacauagagcuaguaacaaccacuguaucgaacauggccgagaucagaagcuacugcuacgaagccuccauauccgacauggccagcgacagcagaugcccgacacaaggagaagccuaccucgacaaacaaagcgacacacaauaugucugcaaacgcacccuagucgacagaggcuggggcaacgggugcggccucuucggcaaaggaagccucgucacaugcgcgaaauucgcaugcuccaaaaagaugaccggaaaaucgauacaacccgagaaccucgaauaccgaaucaugcuaaguguccacggcagccaacacucaggaaugaucgucaaugacaccggacacgagacagacgaaaaccgagccaaaguagaaauaaccccaaacucaccacgggcagaggcgacgcuaggcggauucggcucccugggccucgacugcgaaccacggaccggacucgacuucagcgaccuauacuaccucacgaugaacaacaaacacuggcuaguacacaaagaaugguuccacgacaucccacugccauggcacgcaggcgcagauacaggcacaccccacuggaacaacaaagaggcccuaguagaguucaaagacgcacacgccaaaagacaaaccguagugguacucggcagccaagaaggcgcaguacacacagcacucgccggcgcacuggaagcagaaauggacggagccaaaggccggcuauccagcggccaccugaaaugccgccucaaaauggacaagcucaggcucaagggaguaagcuacagccuaugcaccgcagcauuuaccuucacaaaaauccccgcggaaacucugcacggcaccgucacagucgagguucaauacgcaggcaccgacggcccaugcaagguccccgcacaaauggcuguggacaugcaaacacucaccccugucggcagacucauaaccgccaacccagucauaaccgagagcacagaaaauuccaaaaugaugcuagaacuagacccucccuucggggacagcuacaucgucaucggcguaggggagaaaaagaucacccaccacuggcaccggucaggcucaaccauaggcaaagccuucgaagcaacaguaagaggagccaaacgcauggccguacugggagauacagccugggauuucggaucugucggaggcgcacuuaacagccuuggcaaaggcauccaccaaaucuucggcgccgccuucaagucccucuucggcggaaugagcugguucagccaaauccuaaucggcacccuccuaauguggcucggacucaacaccaaaaacgguuccaucucauuaaugugccuagcccucggagguguccucauauuccuauccaccgcagucuccgccgacguaggcuguagcgucgacuucucuaag

SEQ ID NO: 2858 - RNA, 2136 nt, Artificial Sequence
  KU312314.1 prME-long CDS opt
cgcaucaucaacgcaagaaaagaaaagaaacgcaggggagcagacaccucggucggcauagucggacuccuacucaccaccgccauggcugcugaaguuacacgcagaggaucggccuacuacauguaccuggaccgcaacgacgcaggggaggccauaucguuccccaccacacuuggaaugaacaaaugcuacauacaaaucauggaccucgggcacaugugcgacgcaaccauguccuacgaaugccccaugcucgacgaaggaguagaaccagacgaugucgacugcuggugcaacaccacgagcacaugggucguuuacggcacaugccaccacaagaaaggugaagcccgccgcagucgacgagccgucacccuuccaagccacuccacacgaaaacuccaaaccaggagccaaaccuggcucgaaagccgagaauacaccaaacaccucauaagaguagagaacuggauauuccgcaacccaggcuucgcccucgcagccgccgccaucgcguggcuccuaggcaguagcaccagccaaaaagugauauaccuagucaugauacuacugaucgcaccagcauacucaauccggugcauaggaguaucuaaccgagacuucguagaaggcaugucaggagggacauggguggacguaguccucgaacacggagggugcguaacaguaauggcccaagacaaacccaccgucgacaucgagcuagucaccacgaccgucagcaacauggcagaaguccgguccuacugcuacgaagcaagcaucucggacauggccagugacucccgcugccccacgcagggcgaagcauaccucgacaaacaauccgacacccaauacgucuguaaacgcacacucguagaccgcggcuggggaaacggcugcgggcuauucggaaagggcagcuuagucacaugcgccaaguuugcaugcucaaagaaaaugaccggcaaaagcauacaacccgaaaaccucgaauaccguaucaugcuguccguacacggaucacaacacagcggaaugaucgucaacgacaccggccacgaaacagacgaaaacagagcaaaagucgaaauaacucccaauagcccacgcgcagaggccacacugggcgguuucggcagccugggccuagacugcgaaccccgcacaggccucgacuuuuccgaccucuacuaccucaccaugaacaacaaacacuggcucguccacaaagaaugguuccaugacaucccccucccauggcacgccggcgccgacaccggaaccccacacuggaacaacaaagaagcccuagucgaguucaaagacgcccacgcgaaacgacaaaccguaguaguacucggcagccaagaaggcgcaguucauacggcccucgcgggagcacucgaagcugaaauggacggcgcaaaaggacgacucucaucaggacaucugaaaugccgacucaaaauggacaaauuaagacucaaaggcguauccuacucgcucugcacggcagcauucacguuuacaaaaauaccagcagaaacccugcacggcaccguuaccguagaaguccaauacgccgguaccgacggcccgugcaagguccuagcacaaauggcagucgacaugcaaacauugacacccgucggccgacugaucacagcaaaccccgugaucaccgaaucaaccgaaaacuccaaaaugaugcucgaacuggacccaccauucggcgauagcuauaucgucaucggagucggcgaaaagaaaaucacccaccacuggcaccgauccggcuccacaaucggaaaagcauucgaagcaacaguacggggcgcaaaacggauggcaguccucggcgacacagccugggacuucggcagcgucggcggcgcccucaacagccuaggcaaaggcauccaccaaauauucggugcagccuucaagagccucuucggaggaaugagcugguucagccaaauacucaucggcacacuccuaauguggcugggccucaacaccaaaaacggcagcauaagccucaugugucuggcccuaggaggaguacuaauauuccuauccacugccgucagcgcagacguuggcugcagcguagacuucagcaaa

SEQ ID NO: 2859 - RNA, 2136 nt, Artificial Sequence
  KX446950.2 prME-long CDS opt
cgcaucaucaacgcacgaaaggagaaaaaacgccgaggggccgauaccuccguuggcaucgugggacuccuccuaacuacagcuauggccgcggaagugacccgccgcggaagcgcuuacuacauguaccuagaucgcaacgacgccggcgaagccaucucauucccaacgacacugggcaugaacaaaugcuacauccaaaucauggaccuaggccacaugugcgacgccaccaugucuuacgaaugucccacacuugacgaaggcguagagcccgacgacguagacugcuggugcaacacgacgucaaccuggguuguauacggcacaugccaccacaaaaagggagaagccagacgcagcagaagagccgucacacuacccagccacucgaccagaaaacuacagacccgcagccaaacauggcuggaaucccgcgaauacacaaaacaccuaauacgcguagaaaacuggauauucaggaacccgggcuucgcccuagccgcagcagcaaucgccuggcuccuaggcuccuccacaucccaaaaagucauauaucucgucaugaucuuacucaucgccccagccuacucuauacgcugcaucggcgucuccaaccgcgacuucgucgaaggcauguccggaggaacauggguagacguaguacuggagcacgggggaugcgucacaguaauggcccaagacaaacccaccguagacauagaacuagucaccaccacagucucaaacauggccgaaguccgcucauacuguuacgaagcaagcauauccgacauggccuccgacucgcggugcccaacccaaggcgaggccuaccuagacaaacaaagcgacacccaauacgucugcaagcguacgcugguggaccguggauggggaaacggaugcggacuauucggcaaaggcagccucguuaccugcgcaaaauucgccugcuccaaaaaaaugacaggcaaaucgauucaacccgagaaccucgaauaccgaauaaugcuaagcguccacggaucacagcacuccggcaugaucgucaacgacaccggacacgagacagacgagaaccgcgcaaaaguggaaaucaccccgaacuccccccgugcagaggcaacccuaggcggcuucggcucacucggacucgacugugaacccagaaccggccucgacuucuccgacuuguacuaccucacaaugaacaacaaacacuggcuaguccacaaagaaugguuccacgacaucccccuccccuggcacgcaggagcggacaccggaaccccacacuggaacaacaaagaagcccucgucgaguucaaagaugcccacgcaaaacgccagacagucgucguccuaggaagccaagaaggagcaguacacacagcacucgcaggagcccuagaagccgaaauggacggugcaaaaggcagacucagcagcggacaucucaaaugcagacuuaaaauggacaaacuccggcucaaaggcgucagcuacagccucugcacagcagccuucacauucacaaaaauccccgcggaaacccuccacggcacuguaacggucgaaguccaauacgcaggaacggauggcccaugcaaagucccagcccaaauggcagucgacaugcaaacccucacccccgucggccgucucauaaccgcaaacccggucaucacagaaagcaccgaaaacagcaaaaugaugcuggaacuagacccacccuucggagauuccuacaucgucaucggcguaggcgaaaaaaaaauaacccaccacuggcacagaucagguucgacaaucggaaaagcguucgaagccaccguaagaggcgccaaacgcauggccguccucggagacaccgcaugggacuucggaucuguagguggagcccuuaacucccuaggcaaagguauccaccaaaucuuuggagcugcauucaaaucacuauucggcggaaugucaugguucagucaaauacucaucgggacccuacucauguggcuaggccuaaauaccaaaaacgggucgauaucacuaaugugccucgcacucggcggcguacucauauuucucucaaccgcgguaagcgcagacgugggaugcucagucgacuucagcaaa

SEQ ID NO: 2860 - RNA, 2136 nt, Artificial Sequence
  KY003157.1 prME-long CDS opt
cgaauaauaaaugcacgaaaggaaaagaaacgaagaggagcagacacauccguaggaauagugggacuacuacuaaccacggccauggcagcagaaguaaccaggaggggaucggccuacuacauguaccucgacagaaacgacgcaggagaagcaaucuccuuccccacaacacucggaaugaacaaaugcuacauccagauaauggaucuuggacacaugugcgacgccacaaugagcuacgagugccccauguuagacgaaggcguugaaccagacgacgucgauugcuggugcaacacaaccucaacuuggguagucuacgggacaugccaucacaagaaaggggaggcccgcagguccagacgagccguaacacuccccagccauucaacacgcaaacuccagacgcgcagccagaccuggcucgaaagccgagaauacacaaaacaccuaauccgcguagaaaacuggauuuuuagaaaccccggauucgcacucgcagcagcggcuauagccuggcuccucggauccagcaccagccaaaaaguaaucuaccucguaaugauccugcucaucgccccagcauacagcauccgaugcaucggagugagcaacagagacuucguagaaggcaugucaggcggcaccuggguagauguaguacucgaacacggaggaugcguaacgguaauggcccaagacaaaccaacaguggacaucgaacucgugaccaccaccgucuccaacauggcagaaguacggucauacugcuacgaagccucaaucagcgacauggcaagcgacuccagguguccgacccaaggcgaagcauaccucgacaaacaaagcgacacccaauacgucugcaaacggacccuaguagaccgaggcugggguaacggcugcggccucuuuggaaaaggaagccucguaacaugcgccaaauuugccugcagcaaaaagaugacagggaaaagcauacaaccagaaaaccuagaauacagaauaaugcucuccguccacggcagccaacacucaggcaugauaguaaacgacaccggacacgaaacggacgagaacagagccaaagucgaaauaaccccaaacagcccacgcgccgaagccacgcucgggggcuucggaucauugggauuagacugugaaccccgcacaggucucgauuucagcgaccucuauuaccucaccaugaacaacaagcacuggcugguacacaaagaaugguuccacgacauaccacuccccuggcacgccggugcagacaccggcacaccccacuggaauaauaaagaagcguuggucgaguucaaagaugcccacgcgaagagacaaaccguaguagugcucggcagccaagaaggagccguacacaccgcccucgccggcgcucucgaagccgaaauggacggagccaaaggucgccugagcuccggccaccuaaaaugccgacuaaaaauggacaaacuuagacuaaaaggaguaucauacucacucugcacggcagccuuuaccuucaccaaaaucccggcagaaaccuuacacggaacaguaacagucgaagugcaauacgcaggcacagacggccccugcaaaguccccgcacagauggccguagacaugcagacccucaccccggucggacgccucaucacagcuaacccggugaucaccgaauccaccgaaaacagcaaaaugaugcucgaacuugacccacccuucggcgacagcuacaucgucaucggagugggagaaaagaaaaucacgcaucacuggcaccguagcggaucaacgauaggaaaggccuucgaggccacgguaagaggcgcgaaaagaauggcaguccuaggagacacagccugggauuucgggucggucgguggcgcacucaacucacuaggcaaaggcauccaucaaaucuucggcgccgccuucaaaagccuauucggaggaaugagcugguuuagccaaauacuuauaggcacacuccuaauguggcucggacucaauacaaagaacggaagcaucucacuaaugugucuagcccuaggcgggguccucauauuccuauccacagucgucagcgccgacgucggcugcagcguugacuucagcaaa

SEQ ID NO: 2861 - RNA, 2136 nt, Artificial Sequence
  KX811222.1 prME-long CDS opt
agaaucaucaaugccagaaaagaaaagaaacggcgcggagccgacacauccgucgggauaguaggacuccugcucacaaccgcaauggcagcggaggucacucgacggggcucagcguacuacauguaccucgacagaaacgacgcaggagaagcaauaucauuccccacaacacuaggaaugaacaaaugcuauauccagauaauggaccuaggccacaugugcgacgcgacaaugagcuacgaguguccaaugcucgacgaaggaguagaacccgacgacguagacugcuggugcaacaccaccuccgcauggguaguguacggaacaugccaccacaagaaaggcgaagccagacgcucgcgcagagccgucacccuacccagccacuccacccgaaaacuucaaacccgcccacaaacauggcuagaaucacgggaauacaccaaacaccuaauacgcguugaaaauuggauauucagaaaccccggauucgcacuagcugccgcugccauagccuggcuacuagggaguucaacaucacaaaaagucaucuaccuagucaugaucuuacucaucgcacccgccuacagcauccgcuguauaggagucagcaaucgagacuuuguagagggaaugagcgggggcaccuggguagacgucguccuagaacacggcggaugcguaaccgucauggcgcaagacaaaccaaccgucgacaucgaacucgucacaacaaccgucucaaacauggccgaaguucgaucauacugcuacgaagcgaguauaucagacauggccagcgacucccggugccccacccaaggugaagcauaccuggacaaacaaagcgacacccaguacgucugcaaaaggacccugguggaccgcggauggggcaacggcugcggacucuucggcaaaggcagccucguuacgugcgcuaaauucgccugcagcaagaaaaugacaggcaaauccauccaacccgaaaaccuagaauaccgaaucaugcuaagcguacacggcucgcaacacucaggcaugauagucaacgacaccgggcacgaaaccgacgaaaaccgagccaaaguagaaaucacgccaaacucaccccgagccgaggccacacucggcggcuucggaucccucggccuagacugcgaacccagaacaggucucgacuucuccgaccuauacuaccugacaaugaauaauaaacacuggcucguccacaaagagugguuccacgauaucccacugcccuggcaugccggcgcggacaccggcacaccccacuggaacaacaaagaagcccuaguagaguucaaagacgcacacgccaaaaggcaaaccgucgucguccuaggaucccaagaaggcgccguccacaccgcccucgccggcgcccuagaagcagaaauggacggagccaaaggccgccucucaucaggccaccucaagugccgccuaaaaauggacaagcuacgacuaaaaggcgugagcuacucccucugcacagcggccuucaccuucacgaagauaccagccgaaacacuccacgggaccgucaccguagagguacaauacgcaggaacagacgggcccugcaaaguacccgcccaaauggccguagacaugcaaacccucaccccaguaggacgacucauaaccgccaacccagucauaaccgagagcaccgaaaacagcaaaaugaugcuagaacuagacccacccuucggcgauaguuacauuguaauaggcguaggcgaaaagaaaaucacacaccauuggcacagauccggaucaaccauuggcaaagcauucgaagcaaccguacgcggcgcuaaacgcauggccguacucggcgauaccgcaugggacuuuggauccgucgggggagcauuaaacucacuaggaaaaggcauccaccagauauucggcgccgcauucaaaucacucuucggaggaaugucaugguuuagccaaauacucauaggcacacuccucauguggcuaggccucaacaccaaaaacggaagcauaucccuuaugugccucgcccucggcgguguucucaucuuucuauccacagccgucagcgccgacgucggcugcucagucgacuucucaaaa

SEQ ID NO: 2862 - RNA, 2136 nt, Artificial Sequence
  KX447516.1 prME-long CDS opt
cgcaucaucaacgcccgcaaagaaaagaaacgacgcggcgcugacaccuccguaggcauaguaggacuccuacucaccaccgcaauggcagcagaagucacccgccgaggcagcgcauacuacauguaccucgacagaaacgacgccggugaagccauaucauuccccaccacccucggaaugaacaagugcuacauccaaauaauggaccuuggccacaugugcgacgccaccaugagcuacgaaugcccaaugcucgacgaaggaguagagccagacgacgucgacugcuggugcaacacgaccuccacuugggucgucuauggcacgugccaccacaagaaaggagaagccagaagaucacgccgugcaguaacgcuaccgagccacucaacccgaaaacuucaaacccguagccagaccuggcuagagucacgcgaauacacuaaacaccugauccgcguagaaaacuggauauuucgcaaccccggcuucgcgcucgcagccgcggcaauagccuggcugcuaggaucguccaccuccaaaaagguuauauaccucguaaugauccuccucauagcucccgcauacucaauaaggugcauaggcgucagcaaccgcgacuucgucgaaggcauguccggaggcaccuggguagacgugguccucgaacacggaggaugcgucacagugauggcacaagacaaacccaccgucgacauagaacucgucaccacuacagucagcaacauggccgaagucagaucauacugcuacgaagcaagcaucagcgacauggcauccgacucgcgcugccccacccaaggcgaagcauaccuagacaaacaaagcgacacccaguacguaugcaaacgcacacucgucgaccggggcugggggaacggcugcggucucuucggaaaaggcucccucguaaccugcgccaaauucgcaugcuccaagaaaaugaccggcaaaagcauccaacccgaaaaccucgaauaccgaaucaugcuaucgguccacgguucccaacacagcggaaugauagucaacgacaccggacacgaaaccgacgaaaaccgagccaaagucgaaauaacacccaacagcccgcgagcagaagccacacuaggcggauucggaagccucggccuagacugcgagccccgcacaggauuagacuuuuccgacuuauacuaccuaacgaugaacaacaaacacuggcucguccacaaagaaugguuccacgacauaccacuaccauggcacgcaggggccgacaccggaacaccacacuggaacaauaaagaggcacucguagaauuuaaagacgcacacgcaaaacgacagaccguugucguacucggaucccaggagggagccguccacaccgcacuagccggugcccuagaagcagaaauggacggagcaaaaggaagacuaaguagugggcaccucaaaugccgucuaaaaauggacaagcucaggcuaaaaggcgugagcuacucccucuguacagccgccuucaccuucaccaaaauccccgcugaaacacuacacggaaccgucaccgucgaaguccaauacgccggcaccgacggccccugcaaaguucccgcccagauggccgucgacaugcaaacccucacacccgucggucgacucaucacagcgaaccccgugauaaccgaaagcacugaaaauagcaaaaugaugcucgagcuggacccacccuuuggggacagcuacauaguaaucggcgucggcgaaaagaaaaucacccaccacuggcacagaagcgggagcaccauaggaaaagcauucgaagcaacaguccgcggugcaaaacguauggccguacucggagacacagccugggacuucggcagcguaggcggugcacuaaacagccuaggaaaaggaauacaccaaauauucggagccgccuucaaaagccucuucggaggcaugucgugguucucgcagauucucauaggcacacuucuaauguggcuaggccuaaacaccaagaacggcucaaucagccuaaugugccuggcacucggaggcguccuaaucuuccuaucaacagcagucagcgcagacgucggaugcagcguagacuuuuccaaa

SEQ ID NO: 2863 - RNA, 2136 nt, Artificial Sequence
  KX520666.1 prME-long CDS opt
agaaucaucaacgcacgaaaagaaaagaaacgacgcggagccgacacauccguaggcaucguuggacuacuauuaaccacagcaauggccgccgaaguaacaagaagagguagcgcauacuacauguaucuugaccggaacgacgccggcgaagccaucagcuucccgaccacacuagggaugaacaaaugcuacauucaaauaauggaccugggccauaugugcgacgcaacaaugucauacgaaugcccgaugcucgacgagggcguagaaccggacgacgucgauugcuggugcaacacaacuucaacuugggucgucuacgguaccugccaccacaagaaaggcgaagcccgccgcucgcggcgcgcaguaacgcuacccagccacuccacgcgcaaacuacaaacccgcucccagaccuggcuagaaucgcgagaguacacaaaacaccuaauccgcguggaaaacuggauuuuccgaaacccaggcuucgcccucgcagccgcagcgaucgcauggcuccuaggcaguagcacacgacaaaaaguaauauaucuuguaaugauacuucucaucgcccccgccuacagcauccgaugcauuggcgucagcaacagggacuucguagaaggcauguccggaggaaccuggguagacgucguucucgaacacggcggcugcgucaccguaauggcacaagauaaaccgaccguagacaucgaacuugugaccaccacgguguccaacauggccgaaguaagaagcuacugcuaugaagcaagcaucagcgacauggccagcgacagcagaugccccacacaaggcgaggcuuaccucgauaaacaaucagacacccaguacguaugcaagcgaacccuagucgacagaggcuggggaaacggcugcggccucuucgguaaagggucacucguuaccugcgccaaauucgccugcagcaagaaaaugaccggcaagagcauccaacccgaaaaccucgaauaccgaaucaugcugucaguccacgguagccaacacucagguaugauagucaacgacaccggacacgaaacagacgaaaacagagcaaaagucgaaaucacacccaacagcccuagagcggaagccacccucggaggcuucggcagccuaggccuagacugugaaccacgcacaggccucgacuucagcgacuuauauuaucucacaaugaacaacaagcacuggcuaguccacaaagaaugguuccacgacauaccacuacccuggcacgcaggagcagacaccggcacaccccacuggaacaacaaagaggcacucguugaauuuaaagacgcacacgccaaacgacaaaccgucguaguacuaggaagccaagaaggcgcaguacacacagcccuagccggggcgcuagaagccgaaauggacggcgccaagggacgccucuccuccggacaccucaaaugucggcuaaaaauggacaaacuaagacuaaaagggguauccuacagccucugcacggcagccuucaccuuuaccaaaaucccagccgaaacccuacacgggacagucacaguagaaguucaauacgccgggaccgacggaccaugcaagguccccgcgcaaauggccguggacaugcaaacccuaacaccuguaggccgacucauaaccgccaaccccguaauaaccgaaagcaccgaaaacuccaaaaugaugcucgaauuagaucccccauucggcgacagcuacauaguaauaggcguaggcgagaaaaagaucacgcaccacuggcacagauccggcagcaccaucggaaaagccuucgaggcaaccgugcgaggcgccaaacgcauggccguccucggagacacggcaugggacuucggaucaguaggcggagcccuaaacagccuaggaaaaggaauacaccaaauauucggcgcagccuucaaauccuuauucggcggcaugagcugguucucacaaauacuaaucgggacccugcucauguggcucggacucaacaccaaaaacggaagcauaucccucaugugccucgcacucgggggcguacuaaucuuccugagcacagcaguauccgccgacguagguugcucggucgacuucuccaaa

SEQ ID NO: 2864 - RNA, 2136 nt, Artificial Sequence
  KU729218.1 prME-long CDS opt
cgcauaaucaacgcgcgaaaagaaaagaagcgaagaucggcagacaccagcgucggcauagucggccuacuccucaccaccgcgauggccgcagaagucacacgcaggggcuccgcauacuacauguaccucgaccgaaacgacgccggcgaagccaucaguuuccccacaacacuaggaaugaacaaaugcuacauacaaaucauggaccuggggcacaugugcgacgccacaauguccuacgaaugccccaugcuggacgaaggcguggaaccggacgacguagacuguuggugcaauaccaccagcaccuggguaguguauggcacaugccaccacaagaaaggagaagccagacgcucacggcgcgcagugacacucccaagccacagcacucguaaacuacaaacccgaagccaaaccuggcuagaaucccgagaauauacaaaacaccucauaagaguagaaaacuggauauuccgaaaccccggauucgcgcucgcagccgcagcaauagcauggcuacuuggcucaagcaccagccaaaaagucauauaccuagucaugauacugcucaucgccccagcauacucaaucagaugcauaggcguaagcaaccgagacuucguugaagggaugucuggagggacaugggucgacgucguacuagaacacggaggcugcgucacggucauggcccaggacaaaccaacgguagauauagagcucguaacgacaaccguaagcaacauggcagaaguacgcaguuacugcuacgaagccagcauaucagauauggccuccgacucccgcugccccacacagggagaggccuaccucgacaaacaaucagacacacaauacgucugcaaacggacgcuaguagaccgcggcuggggaaauggaugcggucucuucggcaaaggaucgcuagugacaugugccaaauucgcaugcuccaagaaaaugacaggcaaauccauccaaccagaaaaccuagaguacagaauaaugcucagcguacacggcagccaacacagcggcaugauagucaaugacacaggacacgaaaccgacgaaaaccgggccaagguagagauaacccccaacagcccaagagcagaggcgacccugggcgguuucggcagccucggccuagacugcgagccaagaacaggacucgacuucagcgaccucuacuaccuaacaaugaacaacaaacacuggcuaguacacaaagaaugguuccacgacauaccacuaccauggcacgccggcgcagacaccgggacaccacacuggaacaacaaggaagcccuagucgaguucaaggacgcacacgcaaaacgacagaccgucguaguacuaggaucacaagaaggggccguacacacagcccuagccggugcacuagaagcagaaauggacggagcaaaaggacgccuaucaagcggccaccuaaaaugccgccucaaaauggauaaacuucgucuaaaaggagucagcuacagcuuaugcacugcagcauucacauucacaaaaaucccagcagaaacacuacacggaaccgucacaguggaaguccaauacgccggaacagacggcccaugcaaaguaccagcccaaauggcggucgauacccagacacucaccccagucgggcgacucauaacagcaaacccagucaucaccgaaucgacagaaaacucaaaaaugaugcuagaacucgacccacccuucggcgacagcuauaucguaauagggguaggagagaaaaagauaacacaccacuggcaccggagcggcagcaccauaggcaaagcguucgaagccacaguccguggagcaaaaagaauggcaguauugggggauacggccugggacuucggcagcguaggaggagcccucaacagccuaggaaaagggauccaccaaauauucggcgccgcguucaaaagccuguucggaggaaugagcugguucucccaaauacuaaucgggacccuccucauguggcucggacuuaacaccaaaaacggaagcaucucacuaaugugccuagcacuaggaggagugcuaauuuuccugaguacagccguauccgcggacgucggcugcuccguugacuucuccaag

SEQ ID NO: 2865 - RNA, 2136 nt, Artificial Sequence
  KU761561.1 prME-long CDS opt
agaaucaucaacgcaagaaaagaaaagaaaagacgaggagccgacacaaacguaggaaucgucggacuacuccucacaacugcaauggcagcagaagucacgcgacgaggauccgccuacuacauguaccuagaccgcaacgacgcgggcgaagcaauaucauucccaaccacccuggggaugaacaaaugcuacauacagauaauggaccucggacacaugugcgacgcgaccaugagcuacgagugcccaaugcucgacgaaggcguggaaccagacgaugucgacugcuggugcaacaccacgagcacaugggucguauacgggacaugccaccacaagaaaggagaagcgaggcgaucccggagagccgucacccucccgagccacucaacacgaaaacuacaaacaagaucgcaaaccuggcuagaaucgagagaauauaccaaacaccuaauaaggguagaaaacuggaucuuccgcaacccgggcuucgcgcuagccgcagccgcaauagccuggcugcuagggagcucaacaagccagaaaguaaucuaucuaguaaugauccuccuaauagccccagcauacagcauccgcugcauaggcguaagcaacagggauuucguagaaggaaugagcggaggcacauggguagacguagugcucgagcauggaggaugcgucacagucauggcacaagacaaaccaacagucgacauagaacugguaacaaccacaguguccaacauggcagaaguccgcagcuacugcuacgaagccagcauaagcgacauggcaagcgacagccggugcccaacacaaggagaagccuaccuagacaaacaauccgacacacaauacguuugcaaacgcacguuaguagaccgcggauggggaaacgguugcggacucuucggcaaagguagcuuggugacaugcgccaaauucgccugcaguaagaaaaugacaggcaaaagcauccaaccagagaaccuagaguacagaaucaugcucagcguccacggcucccaacacaguggaaugaucguaaacgacacaggacacgagacggacgaaaacagagcaaaaguagaaaucacacccaacagcccacgggcagaagccaccuugggaggauucggaucccuaggucucgacugcgaacccagaaccggauuagauuucuccgaccucuacuaccuaaccaugaacaacaaacacuggcucguccacaaagaaugguuccacgacaucccauuaccauggcacgccggugccgacacaggaaccccgcacuggaacaacaaagaagcccuaguggaguucaaagacgcccacgcaaaaagacaaacaguagugguucuaggaucccaagaaggugcaguccacacugcacuggcgggugcacucgaagccgagauggacggcgcaaaaggccggcuaucgagcggccaccuaaaaugcaggcucaagauggacaagcuaagacucaaaggcgugagcuacucacucugcaccgcagcguucacauucaccaaaaucccagccgaaacccuacacgggacagucacaguggagguccaguaugcaggcaccgauggcccaugcaaaguaccggcccaaauggcaguagacaugcagacacuaacaccggucggccgacuaauaacagcaaacccaguaaucacagaaagcaccgagaacucgaaaaugaugcuagaacucgaucccccauucggcgacagcuacaucguaaucgggguaggggagaagaaaaucacccaccauuggcaccggagcggcagcacgaucgggaaagcauucgaagccacgguacgaggagcgagacgaauggcaguccucggggacaccgcaugggacuucggcaguguuggcggagcauugaacucgcucgggaaagggauacaccagauuuucggggcagcauucaaaucacuauucggagggaugagcugguucagccagauccucaucggaacccuacugauguggcuuggacuaaacaccaaaaacggauccauaagccuaaugugccuagcccugggaggaguccuaauauuccuaaguacagccguaagugccgacguaggaugcagcgucgacuucucaaaa

SEQ ID NO: 2866 - RNA, 2136 nt, Artificial Sequence
  KY317938.1 prME-long CDS opt
cgaaucauaaacgcccgaaaagaaaagaaacgacgcggagcagaaaccucgguaggcauaguaggacugcuacuaaccacagcgauggcagccgaaguaacaagaagagguucagccuacuacauguaccucgaccgcaacgacgcaggcgaagcgaucagcuucccaacgacgcuaggaaugaacaaaugcuacauacaaauaauggaccugggccauaugugcgacgccacgaugaguuacgaaugccccauguuggacgagggagucgagccagacgacgucgacugcugguguaacacaacgagcacgugggucgucuacggaaccugccaccacaagaaaggcgaagcccgacgaucaagacgcgcaguaacacuaccgagccacuccacacgcaaacuccaaacaagaagccaaaccuggcucgaaagccgagaauacacaaaacaccuaauccgcguagaaaacuggaucuuccgcaacccaggcuucgcacuagcagccgccgcaauagcauggcuccucgguagcagcaccagccaaaaagucaucuaucuaguaaugauacuccuuauagcgccagcauacuccauucgaugcaucggcguuaguaaccgcgacuucguagaaggaaugucggguggaaccuggguagacgugguacucgagcacgguggcugcguaacggugauggcgcaagacaaacccacagucgacaucgaacucgugacaacaacaguaagcaacauggccgaaguccggucauacugcuacgaggcaucaaucagcgauauggccucagacagccgcugccccacgcagggcgaagccuaccucgacaaacaguccgacacacaauacgucugcaaacgaacgcuagucgacaggggaugggggaacggcugcggacucuucggcaaaggaucccuaguaaccugcgcaaaauucgccugcucaaagaaaaugacaggaaaaagcauucaaccagaaaaucuagaauacagaaucaugcugucaguucacggcucacaacacagcggcaugauaguaaacgacacaggccacgaaacagacgagaaccgagccaaaguagaaaucacucccaauagcccaagagcagaagcaacccuuggaggguucgggucacuuggacuagacugcgaaccacgaaccggccuagacuucagcgaccuuuacuaccucaccaugaacaauaaacacuggcucguacauaaagaaugguuccacgacaucccacugccguggcacgcaggcgccgacacagguacaccacacuggaacaacaaagaagcacugguagaguucaaagacgcccaugcgaaacgccagaccgucguugugcugggcucacaagaaggagccguacacacagcacuggccggagccuuagaagccgaaauggacggcgcgaaaggacgcuuguccuccggccaccucaaaugccggcuaaaaauggacaaacuacgccugaaaggaguuucguauucacugugcacagcagcguucaccuucaccaaaauaccagccgaaacccuacacggcacaguaaccgucgaaguacaauacgcgggaaccgacgggcccugcaaaguuccagcacaaauggcgguagacaugcaaaccuuaacaccgguaggcagacuaaucacagccaacccagucaucaccgaaaguacggaaaauucgaaaaugaugcuagaacuagacccgccauucggagacagcuacauaguaaucggggucggcgaaaagaaaauaacacaccacuggcacagaagcggcagcacgauaggcaaagccuucgaagccaccgucagaggcgcgaaacggauggcaguacuaggcgacaccgccugggacuucggcagcgucggcggagcccucaacagcuuaggcaagggaauccaccaaaucuucggcgccgcauucaagagccucuucggcggcaugucgugguucucccaaauccucauaggcacucuacuaauguggcuaggacucaacacgaaaaacggcagcauaagccugaugugccucgcguuaggcggaguccucauauuccugagcacagccgucucagcggacgucgggugcagcguggacuucagcaaa

SEQ ID NO: 2867 - RNA, 2136 nt, Artificial Sequence
  KY075939.1 prME-long CDS opt
agaauaaucaacgcccgcaaagagaaaaagcgcagaggcgcagacacauccguaggcauaguaggccuacuccugacaacagcaauggccgccgaaguaacccgucgaggaucagccuacuacauguaucuagaccgaaacgacgccggagaagcuaucagcuuccccaccacacucggcaugaauaaguguuacauccaaaucauggaccucggccacaugugcgacgcaaccaugagcuacgaaugcccaaugcuggacgaaggcguagaacccgacgacgucgacugcuggugcaacaccaccuccaccugggucgucuacggaaccugccaccauaagaaaggggaagccagacggagccgacgugcgguaacgcuccccagccacucaacucgcaaacuccaaacccgcagccaaacguggcucgaaagccgggaauacaccaaacaccuaaucagaguggaaaacuggauauuccgaaaccccggauucgcgcucgcagcagccgcgauagcuuggcugcucggaagcuccaccucccagaaaguaauauaucuagucaugauccuccucauagcacccgccuacagccuccgcugcauaggcguauccaaccgagacuucguggaaggcaugagcggcggcaccuggguagaugucguacucgaacacggaggcugcgucaccguaauggcccaagacaaacccacaguagacauagaacuugucacaaccaccguauccaacauggccgaagugcgguccuacugcuacgaagccagcauaucagacauggccucggacucacgaugcccaacccaaggcgaagccuaccucgacaaacaaagcgacacccaauacguaugcaaacgcacacucguagacagaggauggggcaacgggugcggucuuuucggaaaaggaucacucgucacaugcgcaaaauucgccugcuccaaaaagaugaccggaaaaucaauccaaccagaaaaccuagaauaccgcaucaugcucagcguacauggcucccaacacuccggcaugauagucaacgacaccggacacgaaaccgacgaaaaccgcgcaaaaguagaaaucacacccaacagcccacgagccgaagccacccugggaggguucgggagccuaggacucgacugcgaaccgcgaacgggacuagacuucuccgaccucuacuaccuuaccaugaacaacaaacacuggcucguccacaaagaaugguuccacgacaucccauuaccauggcacgccggcgcugauaccggcaccccacacuggaacaacaaagaagcccucgucgaguucaaagacgcucacgcgaaacgccaaaccguagucguacucggcucacaagaaggcgccgugcauaccgcacuagcaggggcacuagaagcagaaauggacggcgcaaaaggccgccucagcucuggccaccuuaaaugcagacuaaaaauggacaagcuacgccuaaagggcgugagcuacucacugugcaccgcagccuuuaccuucaccaaaauccccgccgaaacucuccauggaaccguaacagucgaaguccaguacgccggcacggacggaccaugcaaaguccccgcacaaauggccguugauaugcaaacacugacacccgugggaagacucaucaccgccaacccagucaucaccgaaagcacagaaaacucaaaaaugaugcuggaauuagacccaccauucggcgacucauacaucgugaucggggucggagaaaagaaaauaacacaccacuggcaccgcagcggaucaacaauaggcaaagcauucgaagccacagucagaggggcaaaaagaauggcgguacuaggagacacagcaugggacuucggcucagugggcggagcccucaacucccuuggaaaaggcauucaccaaaucuucggggcagcauucaaaucccuauucggaggaauguccugguucucgcaaauacucaucggcacgcuccuaauguggcuaggacuaaacaccaaaaacggaaguauaucccuaaugugccucgcgcucggaggcguacuaauuuuccugagcaccgcagucagcgcagauguaggcugcuccgucgacuucagcaag

SEQ ID NO: 2868 - RNA, 2136 nt, Artificial Sequence
  KX806557.2 prME-long CDS opt
cgcauaaucaaugcacgaaaggagaaaaagcgcaggggagccgacaccaacguaggcauagucggccuacuucuaacaacagcaauggcggccgaaguaacaagacgcggaucagccuacuacauguaccucgaccgaaacgacgccggcgaagccaucagcuuccccaccacccucggcaugaacaaaugcuacauacagauaauggaccucggucacaugugcgacgccacaaugucauacgaaugccccaugcuagacgagggaguggaaccggacgacgucgacugcuggugcaacaccaccagcaccuggguagucuacggaaccugccaucacaagaaaggcgaagccagaagaucccgacgcgcuguaacccuccccagccacagcacucgcaaacuccaaaccaggucacaaaccuggcuagaaucucgagaguacacaaaacacuuaauacgaguagaaaauuggauguuccgaaaccccggauucgcccucgcggcagcagcaauagccuggcuccucggauccuccacaucgcaaaaagucauauaccuuguuaugauccuacuaaucgcaccggcauacagcauccgcugcaucggagucucaaacagagacuucgucgaaggaaugucgggcggcacaugggucgacgucguucuugagcacggaggaugcgucacggucauggcucaagacaaaccuacaguagacauagagcugguuacaacaaccguguccaacauggccgagguccgguccuacugcuacgaggcauccaucagcgacauggccuccgacucacgaugcccaacccaaggggaggcuuaccucgacaaacaaagcgacacacaauacgucugcaaacgaacacugguugauaggggauggggcaacggcugcggccuuuuuggcaaaggaagccuggucacaugcgccaaguucgccugcagcaagaaaaugacgggcaaaaguauacaaccagaaaaccuggaauaccgaaucaugcucagcguccacgguucccaacacuccggcaugauaguaaacgacacaggccacgaaacagacgaaaacagagcaaaagucgaaaucacccccaacagcccacgggccgaagccacacugggcgguuucggcagccucggacucgacugcgaaccgcgcacgggacucgacuucucagaccucuacuacuuaacaaugaacaacaaacacuggcucguccacaaagaaugguuccacgacauuccccuaccauggcaugccggagcggacaccggcacaccccacuggaacaacaaagaagcacuggucgaguucaaagacgcacacgccaaacggcaaacagucgucguccuaggaucacaagaaggagcaguccacacggcacuagcgggcgcccuagaagccgaaauggauggcgcaaaaggccggcuaucaagcggacaccuaaaaugcagacuaaaaauggacaaacuuagacucaaaggcguaagcuacagcuuaugcacagccgccuucaccuucacgaaaauccccgcagaaacacuccaugguacagucacgguagaagugcaauacgccggcacagacgggccaugcaaagucccugcacaaauggcagucgacaugcagacccuaaccccagucggccgacucauaacggccaauccagucaucacagagucaaccgagaacagcaaaaugaugcucgagcucgacccgccauucggcgacagcuauaucgucaucggugucggcgaaaagaaaaucacacaccauuggcacaggagcgguagcacaauaggcaaggcauucgaagcaaccguccgcggcgccaaacgcauggccguccuaggagacaccgccugggacuucggaucaguagggggcgcccucaauagccugggcaaaggcauccaucaaaucuucggggcagccuucaaaagccuuuucgguggaauguccugguucagccaaauccucauaggcacccuccuaauguggcucggccucaacacgaaaaacggguccauaucccucaugugucuagcacuaggcggaguccucaucuuccucuccaccgcggucucggccgacgucggaugcucgguagauuucucaaaa

SEQ ID NO: 2869 - RNA, 2136 nt, Artificial Sequence
  KU870645.1 prME-long CDS opt
agaauaaucaacgcccgaaaagagaaaaagcgccgaggcgccgacacaagcgucggcaucgucggacuucuccuaacaacagccauggccgcggaaguaacaagaaggggcagugcauacuacauguaccucgaccgcaacgacgcaggagaagccaucagcuuccccacaacauuaggcaugaauaaaugcuacauacagaucauggacuugggccacaugugcgacgccacaaugagcuacgaaugccccaugcucgacgaaggcguagaaccagacgacgucgacugcuggugcaacacaacaagcacgugggugguauacggaaccugccaccacaagaaaggagaagcaagacgaagccguagagcagugacacuccccagccacucgaccagaaaacugcaaacacgcagccaaaccuggcucgaaucacgagaauacaccaaacaccucauccgagucgaaaacuggauacuacggaaccccggauuugcacucgcagcagccgccaucgcauggcuacucggcucaucgaccucccagaaagucauauaccuuguaaugauacuccuaaucgcgcccgccuacagcauccgaugcaucggcgugucuaaucgagacuucguagaaggcaugagcggaggcacaugggucgacgucguacuggagcacggaggcugcgugacgguaauggcacaggacaaacccacagucgacauagagcuagucacaacgaccgucuccaacauggcagaaguacgcagcuacuguuacgaagccagcauaagcgacauggccagugacagccggugcccaacccaaggggaagccuaccuagacaaacaaagcgacacacaauacguaugcaaaagaacccucgucgaucgaggcuggggaaacggaugcggccucuucgggaaaggaucccucgugaccugcgccaaauucgcaugcagcaagaaaaugaccggaaaaaguauacaaccagaaaaccuagaguaucgcauaaugcuaucaguccacggcucccaacacuccgggaugauagucaacgacaccggccacgaaacagacgaaaaucgcgcaaaagucgaaaucaccccaaacagcccaagagcugaagccacccuaggaggauucggaucccucggccucgacugcgaaccacgaacaggccucgacuuuuccgacuuauauuaccucacaaugaacaacaaacacuggcuaguccacaaggaaugguuccacgacaucccacuacccuggcacgcaggcgcagacacaggcaccccacauuggaacaacaaagaagcacucguggaguucaaagacgcucacgcaaaacgccaaacaguaguaguccuaggcucacaagaaggugccguccacacagcucucgccggagcccuagaagcagaaauggauggagcaaaaggccgccugucgagcggccaccucaaaugucgacuaaaaauggacaaacuacgccuaaaaggcgucagcuacagcuuaugcacagcagccuucaccuucacaaaaauaccggcggaaacacuccacggcacggucacgguugaaguccaauacgccggcacagacggucccugcaaagucccagcacaaauggcagucgacaugcaaacccuaaccccaguagggcgucuuaucacagccaacccagucauuaccgagucaacagaaaacaguaaaaugaugcuagaacucgacccacccuuuggggacucguacaucgucaucggaauaggagaaaagaaaauaacccaccacuggcaccgaagcggcuccaccauaggcaaagccuucgaagcaacaguaagaggagcaaaacgcauggcaguacuuggagacaccgcgugggacuucggaagcgucggaggcgcgcucaacagccucggcaaaggcauccaccagaucuucggcgccgcguucaaaagccuguucggaggaaugucaugguucucccagauacuaaucggaacccuccuaauguggcuagggcugaacacgaaaaacggaucgauaagccuaaugugucucgcccuaggaggcguacuaauauuccucuccacagcaguaagcgcagacgucggcugcuccguagacuucucaaaa

SEQ ID NO: 2870 - RNA, 2136 nt, Artificial Sequence
  KU729217.2 prME-long CDS opt
aggauaauaaacgcacgaaaagagaaaaagcgaagaggagccgacacauccgucggaaucgucggacugcuauuaacaacagccauggccgcagaagucacccgcagaggcuccgccuacuacauguaccuagaccgaaacgacgcgggugaagcaaucuccuuccccaccacacucgguaugaacaaaugcuacauacagaucauggaccucggccacaugugcgacgcaacgauguccuacgaaugcccaaugcuagacgaaggcguagaacccgacgacgucgacugcuggugcaacacaaccaguacaugggucguauacgggaccugccaccacaagaaaggagaagcccgaagaucccggcgggcaguaacccuaccgucacacuccacacgcaaacuucaaacgcgaagccaaaccuggcuagagaguagggaauauacaaaacaccuaauaagaguagagaacuggauauuccgcaaccccggauucgcgcucgcggccgccgcaauagcauggcuacucggcagcagcaccagccagaaaguaauauaccuagucaugauccuacucauagccccggcuuacucaauccgcugcauaggggucagcaaccgcgacuucguagaaggcaugagcggaggaacauggguggauguaguacuagagcacggcgggugcguaaccguaauggcacaagacaaaccuaccgucgacaucgaacucguaagcacaacuguauccaacauggccgaaguaaggucuuacugcuacgaagccaccauauccgacaucgccuccgacuccagaugcccaacgcaaggggaagccuaccuagacaaacaauccgacacacaauauguaugcaaacgaacccuagucgacagaggauggggaaacggcugcggacuauucggcaaaggaagucugguaaccugcgcaaaauucgcaugcuccaagaaaaugacaggaaaauccauacaacccgaaaaccucgaauaccgcaucaugcuaagcguccacggaagccaacacagcggaaugaucgucaacgacaccggacacgaaaccgacgaaaaccgagccaaaguagaaaucacaccaaacagcccccgcgccgaagccacccucggcggcuucggcucccuaggacuggacugcgaaccacgaaccggccuagacuucagcgaccuauacuaccuaaccaugaacaacaaacacuggcuaguccacaaagagugguuccacgacaucccauugcccuggcacgccggagccgacaccgguacaccccacuggaacaacaaagaagcccuaguagaauuuaaagacgcccacgcuaaaagacaaaccgcagucguccucggaucccaagaaggcgccguacacacagcacuagcaggcgcgcucgaagccgaaauggauggcgcgaaaggaagacucagcagcgggcaccucaaaugccgguuaaaaauggacaaacuccgccucaaaggcgucucauacagccucugcaccgcagcuuucaccuucacuaaaauccccgcggaaacucuacacgggacagugaccgucgaaguccaauacgccggaacagacggcccaugcaagguaccagcacaaauggcagucgacaugcaaacccuaaccccgguaggaagauuaauaacggccaacccuguaauaaccgaaagcaccgaaaacagcaagaugaugcucgaacucgaucccccuuuuggcgacagcuacaucguaaucggcgucggcgaaaagaaaaucacccaccacuggcaccgauccggauccacaaucggcaaagccuucgaagcaacgguccggggagccaaacgaauggcgguccugggagacacggcaugggacuucggauccguagguggggcccuaaacucguuaggcaaaggcauccaccagaucuucggcgcagccuucaaaucacucuucgggggaaugagcugguucucgcaaaucuuaaucggaacacuucuaauguggcucggccuuaacaccaaaaacggaagcaucucgcugaugugccuagcacuaggcggaguccucauauuccuaagcacagccguauccgcagacgugggcugcagcguugacuuuagcaaa

SEQ ID NO: 2871 - RNA, 2136 nt, Artificial Sequence
  KU497555.1 prME-long CDS opt
agaaucauaaacgcacgcaaggaaaagaaacggcgcggcgccgacacauccguaggcaucgucggcuuacuccuaacaacagcaauggcagccgaaguaacaaggcgaggaagugccuacuacauguaccuggacaggaacgacgcaggagaagccaucagcuucccaaccacucucggcaugaacaaaugcuauauacaaaucauggaccuaggacauaugugcgacgcaaccaugagcuacgaaugccccaugcuagacgaaggaguggaaccagacgauguagacugcuggugcaacacaaccucaacaugggucguauacggaaccugccaccacaagaaaggugaagcccgacgcucaagacgagcgguaacacucccuagccacucuacccgaaaacuccaaacccgcagccaaacauggcucgaaucccgagaguacacaaaacaccuaauacgaguagaaaacuggauauuccgaaacccgggauucgcccuagccgcagccgcaaucgccuggcuccuaggcagcagcaccucgcaaaaagucaucuaccuagucaugauacuacucauagcccccgccuacagcauccgcugcauaggaguaucgaaccgggacuucguagagggcaugagcggcggcaccugggucgacguaguacuagaacacggcgggugcguuacggucauggcacaagacaaacccacggucgacaucgagcuagucacgaccaccgucucaaacauggcagaaguccgcuccuacuguuacgaagcaucaaucagcgacauggcguccgacuccaggugcccgacccaaggagaagccuaucucgacaagcaaagcgacacacaguauguuugcaagcgcacccuugucgacaggggcugggguaacggcugcggccucuucgggaagggcucccuagucacaugugcaaaauucgcaugcagcaagaaaaugaccggcaaauccauccaaccagaaaaccucgaauaccgcauaauguuaagcguacacggcucccaacauuccggcaugaucguuaacgacaccggacacgaaacagacgaaaaccgagcaaaagucgaaauaacaccaaacagcccccgagcagaagccacccuaggaggauucggaucacucggacuagacugcgaaccgcgaaccggacucgacuucucagaccuuuacuaccuaacaaugaacaacaaacacuggcucguacacaaagaaugguuccacgacauaccacugcccuggcacgccggcgcagacacaggaacgccacacuggaacaacaaagaagcccuagucgaguucaaagacgcacacgccaagcgacaaacagugguaguacucggaacccaagaaggggccguccacaccgcccuggcaggagcacucgaagccgaaauggacggggcgaagggacgccucuccucaggacacuuaaaaugcagacuuaagauggacaaacuccgacuaaaaggagucagcuacagccuaugcaccgcagcauucacguucaccaaaauaccagcugaaacacuccacggcacggucacagucgaaguccaauacgccggcacagacggaccaugcaaaguacccgcccagauggccguggacaugcaaacgcucacccccgucggacgccucauaaccgccaaccccgucauaaccgaauccaccgaaaacagcaaaaugaugcuagaacucgacccucccuucggagacucauacaucgucauaggcgucggcgaaaagaaaaucacgcaccauuggcacagauccggaucaacaauaggcaaagcauucgaagcaacagugagaggggccaagcgaauggcaguccuuggagacacagcaugggacuucggaagcguagguggugcgcuaaacucccuaggcaaaggaauccaccaaaucuucggagcagcauucaaaagccuuuuuggcggaaugucgugguucagccaaauccuaaucgggacgcugcuaauguggcuaggacuaaacacgaaaaacggauccaucucgcugaugugccuagcacuaggcggaguccugaucuuccuuucaaccgccgucuccgcagacguaggcugcucagucgacuucuccaaa

SEQ ID NO: 2872 - RNA, 2136 nt, Artificial Sequence
  KX087101.3 prME-long CDS opt
cgaauaaucaacgcccgaaaagaaaagaaaagacgaggggcagacacauccgucggcauaguagggcuccuccucacaacagccauggccgcagaaguaacccgacgaggcagcgcauacuauauguaccucgacaggaacgacgccggugaggcaauaucguuccccacgacccucgggaugaacaagugcuauauacagaucauggaccucggccacaugugcgacgcaacaaugucauacgaauguccaaugcucgacgagggaguagaacccgaugacguugacugcugguguaacaccaccagcacguggguugucuacggaaccugccaucacaagaaaggcgaagcccgacgcucccgcagagccgucacacugcccucgcauucaacaagaaaacuccaaacacgcucccaaacauggcucgaaucccgcgaauauacaaaacaccucauccgcguagaaaacuggauauucaggaaucccggguucgcccuagccgccgcagcaaucgccugguugcucggcucaagcaccagccaaaaaguaauauacuuagucaugauccuacucaucgcccccgcguacagcauccgcugcaucggagucaguaaccgggacuucgucgaaggcauguccggaggaacauggguggacgucguacuagagcacggaggcugcgugaccguaauggcacaagacaaacccacaguagauauagagcuaguaacgacaaccguauccaacauggcagaaguucgaagcuacugcuaugaagcaagcaucagcgacauggcaagcgacucccgaugccccacccagggagaagccuaccuagacaagcaauccgacacacaauacguaugcaaacgaacccucgucgaccgcggauggggaaacggcugcggccuauucgggaaaggaucccuaguaacaugcgcaaaauucgcaugcagcaagaaaaugaccgguaagagcauccaacccgaaaaccucgaauaccgaauaaugcucaguguacacggcucccaacacagcggcaugaucguaaacgacacaggacacgaaaccgacgaaaaccgugcgaaaguggaaauaaccccgaacucccccagagccgaagcaacccuaggcggcuucggaucacugggccucgacugcgaaccaagaaccggacuagacuucuccgaccuauacuaccucacaaugaacaacaaacacuggcucguacacaaggaaugguuccacgacauaccccuccccuggcacgccggagcagacacagggacaccgcacuggaacaauaaagaagcccuggucgaguucaaagacgcucacgcaaaacgccaaacugucgucguccuuggcagccaagaaggcgccguccacacagcacucgccggugcccucgaagccgaaauggacggagccaaagggcggcuaagcagcgggcaccugaaaugccggcuuaaaauggacaaacuccgacugaaagguguaucauacagccuaugcaccgcagccuucacauucacaaaaauacccgcagaaacacuccacggaaccgucacagucgaacuccaauacgccggaaccgacggacccugcaaagugccagcccaaauggcaguagacaugcaaacgcucacucccguaggccgccuuauaacugcgaaccccgucauaaccgaaagcacagaaaacagcaaaaugaugcucgaacucgaucccccguuuggggacucauacaucgucauuggcgugggcgaaaagaaaaucacgcaccacuggcaccgcucaggcagcacuaucggaaaagcauucgaagcaaccguccgcggcgccaagagaauggcuguacucggcgacaccgcaugggacuucggaucggucggaggggcccucaacagccucggcaaaggaauacaccaaaucuucggcgccgccuucaaaucucuauucggagggaugucgugguuuucccagauccugauaggcacccuccucauguggcuaggccucaacacgaaaaacggcuccauuagccuuaugugccucgcccuaggcggcguauuaaucuuccucucaacagcagucagcgccgacguagggugcagcgucgacuuuucaaaa

SEQ ID NO: 2873 - RNA, 2136 nt, Artificial Sequence
  KY075932.1 prME-long CDS opt
cggaucaucaacgcccgcaaagaaaagaagcgcagaggagcagaaaccuccgucggcauagucggccugcuacuaaccaccgccauggccgccgaagucaccagacgaggcuccgccuacuacauguaccucgacagaaacgacgccggcgaagccaucuccuucccuacaacccucggcaugaacaaaugcuacauacaaauaauggaccuaggccacaugugcgacgccacuaugagcuacgaaugccccaugcucgacgaaggagucgaacccgacgacguggauugcuggugcaacaccacaucgacaugggucguguacgggacgugccaccacaaaaagggagaagccagacgaucacgcagagccgucacacuccccagccacagcacgagaaaacuacaaacacguagccaaacguggcucgaaagccgcgaauacaccaagcaccucauccgcaucgagaacuggauauuccgcaaccccggcuucgcacuagccgcggccgccaucgcauggcuacucggaucgagcaccucacaaaaagucauauaccuagucaugauccuacuaauagcccccgcauacuccauacgcugcauuggcgucagcaaccgggacuucguagaaggcaugagcgguggcacaugggucgacgucguccucgaacacggaggcugcguaaccgucauggcucaagacaaaccuacgguagacauagaacugguuaccacaacagucagcaacauggccgaaguccgcagcuauugcuacgaagcaagcauaucagacauggccagcgacucccguugcccaacacagggagaggcauaccuagacaaacaauccgauacacaguacguaugcaaacguacccucgucgaccgcgguuggggcaauggcugcggccuauucggaaaaggaagccucgucacaugugcaaaauucgccugcaguaagaagaugacaggcaaaucaauccaacccgaaaaccuagaauacagaauaaugcucucgguccacggaagccaacacuccggaaugaucguaaacgacaccggacacgaaaccgacgagaaccgcgccaaggucgaaaucacccccaacucaccacgcgcggaagcaacacugggaggcuucggaucacucggacucgacugcgaaccccgaaccggauuagacuuuuccgaccucuacuaccucacaaugaacaauaaacacuggcucguccacaaggaaugguuccaugacauaccacuacccuggcaugccggcgcggauacgggaacgccccacuggaacaauaaggaggcccucguggaguucaaagacgcccacgcaaaacgccaaaccguaguagugcucggcagccaagaaggagcuguccacaccgcccuggccggagcccucgaagccgaaauggacggggcgaaaggacgccucuccucgggccaccugaaaugccgccuaaaaauggacaaacuccgauuaaaaggggucaguuacagccuaugcaccgcggcauucaccuucacaaaaauaccagcagaaacacuacauggaaccgucacagucgaaguccaguacgccggcacagacgguccauguaaaguccccgcacaaauggccgucgacaugcaaacacugacuccagucggaagacucaucaccgcaaacccaguaauaaccgaaucaaccgaaaacuccaaaaugaugcucgaacucgacccaccauucggcgacuccuacauaguaauaggcgucggagaaaagaaaauaacacaccacuggcaccgaagcggauccaccauuggcaaggcuuuugaagcaaccguacgaggagccaaacgcauggccgugcuaggagacaccgccugggacuucggcuccgucggcggcgcccuaaacucccugggcaaaggcauacaucaaauauucggcgccgcauucaaaucacucuucggaggcaugagcugguucagccagauccucauaggcacccuccuuaugugguugggccucaacaccaagaacggaagcaucucccucaugugccuagcacucggcggcguacucauauuccucucaacagccgucagcgccgacguaggcugcagcgucgacuucucuaaa

SEQ ID NO: 2874 - RNA, 2136 nt, Artificial Sequence
  KY014317.1 prME-long CDS opt
agaauaauaaacgcacgaaaggaaaagaaacgccgaggcgcggacacaagcgugggaauagucggacuccuacucacaacggcaauggcagccgaagucacacgaaggggcucagcuuacuacauguaccuggacagaaacgacgccggggaagcaaucagcuuuccgaccacacuaggaaugaauaaaugcuacauacaaauaauggaccucggacacaugugcgaugcaaccaugucguacgaaugcccaaugcuugacgagggcguagagcccgacgacgucgauugcugguguaacaccacgagcacauggguaguuuauggaacaugccaccacaagaaaggagaagcacgcagaagcagacgcgcugucacgcucccaagucacagcacgcgcaagcuccagacccggagccagaccugguuagaaagccgcgaauacaccaaacaccucaucagagucgaaaacuggaucuucagaaacccaggguucgcacuagcagccgccgccauagccuggcuacucggauccuccacgagccagaaaguaauauaccucguaaugauacuccugaucgcaccagcauacucgauccgcugcauaggcguaagcaaccgggacuucguggaagggaugucaggaggaaccugggucgauguaguucuugagcacggaggaugugugacgguaauggcucaggacaaacccacgguagacauugaacucgucaccaccaccgugagcaacauggcagaagugcgaucauacugcuacgaggccuccauauccgacauggccagugacucaagaugcccaacgcaaggagaagcguaccuagacaaacaaucagacacgcaguacgucugcaaacgaacgcuagucgaccgcggaugggggaacgggugcggacuauuuggcaaaggcucacuggugacaugcgccaaauuugcaugcucaaagaaaaugacaggcaaauccauacaacccgagaaccucgaauaucggaucaugcuauccguacauggcucacaacauagcggcaugauagucaacgacacaggacacgaaacagacgagaacagagccaaagucgaaauaaccccaaauagcccccgcgcggaagcaacccucggaggauucggaagccuaggacuggacugugaaccaagaacaggcuuggacuuuagcgaccucuacuaccugacaaugaacaacaaacacuggcuaguccacaaagaaugguuccacgacauaccgcuaccguggcacgcaggggccgacaccggcaccccgcauuggaacaacaaagaggccuuagucgaguucaaagacgcacacgcaaaaagacaaacgguaguaguacucggcucgcaagaaggcgccguacacaccgcgcucgcaggagcccucgaagcggaaauggacggagcaaaaggucgccugagcuccggccaucucaaaugcagacuaaaaauggacaaacugagacucaaagggguaucuuacagccuaugcacggcagccuucacauucacaaaaaucccugccgagacacuacacgggacggucacagucgagguacaauacgccggaaccgacggaccaugcaagguacccgcccaaauggccgucgacaugcaaacacuaacaccagucgggcgccuaaucacagcuaaucccgucaucacugaaucaaucgaaaacagcaaaaugaugcuagaacuagauccgcccuucggcgacagcuacaucguaaucggcgucggagaaaagaaaaucacacaccacuggcauagaagcgggagcacaauaggcaaagcauucgaagccacaguacgcggagcgaaacgaauggcaguccucggcgacaccgcgugggauuucgggagcgucggcggcgcacucaacucgcucggaaaaggaauccaccaaaucuucggagccgcauucaaaagccuauuuggcggcaugagcugguuuagccaaauacucaucggaacacuccugauguggcucggacucaacacgaaaaacggcagcauaaguuugaugugccucgcccucggagggguacucauauuucugagcacagccgucagcgcagacguagggugcagcguggacuucagcaag

SEQ ID NO: 2875 - RNA, 2136 nt, Artificial Sequence
  KU758876.1 prME-long CDS opt
cgcaucauaaacgcccgcaaagaaaagaaacgcagaggcgcagacacaucagucggcaucguaggacuucuacuaacuaccgcgauggcagcagagguaacccgccgcggauccgcauauuacauguaccucgaccgcaacgacgcgggcgaagcaaucucauucccaacaacccugggaaugaacaaauguuacauccaaaucauggaccucggacacaugugcgacgcaaccauguccuacgaaugccccaugcuagacgaaggcgucgaaccagacgacgucgacugcuggugcaacaccaccagcacauggguuguauacggcacgugucaucacaagaaaggagaagcgcgccgaagccgacgcgcagugacgcugcccucccacuccacccgcaaacugcaaacgcgcucccagacauggcuagagagccgagaguacaccaaacaccuaauccgaguagaaaacuggaucuuccgcaacccaggcuucgcacucgccgccgccgcaaucgccuggcuacucggaucuagcaccagccaaaaaguaaucuaccucgucaugauccuccugaucgcucccgccuacagcauccggugcaucggggucagcaacagagacuucguagaaggaauguccgggggaacauggguagacgucguccuagaacacgggggcugcguaacugucauggcucaggacaaacccacagucgacauagaacuugucaccaccaccgucagcaauauggcggaaguacgcagcuacuguuacgaagcaagcauaucagacauggccucugacagccguugcccgacccaaggagaagcauaucucgacaaacaguccgacacccaauacgucugcaaacgaacccucguagaccgaggaugggggaacggauguggacucuucggcaaaggaagccucguaaccugcgcaaaauucgcauguuccaagaaaaugaccggcaaaucaauccaaccagaaaaccucgaauaccgaaucaugcucagcguccacggaucccagcacuccggcaugaucguaaacgauacuggccacgaaaccgacgaaaaccgagccaaagucgaaauaacccccaauagcccacgcgccgaagccacccuaggcggauucggcucccucggccucgacugcgaaccacgcaccggccuagacuucagcgaccucuauuaccuaaccaugaacaacaaacacuggcugguccacaaagaaugguuccacgacaucccccucccuuggcacgccggggcggacacaggaaccccacacuggaacaauaaagaagcacucgucgaguucaaagacgcacacgcuaaaaggcaaaccgucguaguacuaggcagccaagaaggagcaguucacaccgcauuagccggcgcacuagaagccgaaauggacggagucaaaggacgccucuccuccggacaccuaaaaugccgccucaaaauggacaaacuacgccuaaaaggaguaaguuauucacucugcacagcagccuucacauucaccaaaaucccagcagaaacccuacacggcacagugacaguggaaguccaauacgcaggcaccgacggcccaugcaaagucccugcacagauggccgucgacaugcaaacccucacaccagucggcaggcucaucaccgcuaacccaguaaucaccgaaucaaccgaaaacucaaagaugaugcucgaacucgacccgcccuuuggggacuccuacaucgugaucgggguuggggaaaagaaaaucacccaccacuggcaccguucaggaucaacaaucggcaaagcauucgaagcaaccguacgaggcgcaaaaagaauggccguacuaggcgacacagcaugggacuucggcucagucggcggggcccuaaacucccucggcaaaggcauacaccaaaucuucggagcagcauucaagucccucuucggcggcaugagcugguucagccaaauccucaucggcacacugcuaauguggcugggacucaacaccaaaaacggaucgaucucauucaugugccuggcacucgguggcgugcucauauuccucagcacagccgucuccgcagacgucggcugcagcguagauuucucaaag

SEQ ID NO: 2876 - RNA, 2136 nt, Artificial Sequence
  KU758874.1 prME-long CDS opt
aggauaauaaacgcccgaaaggaaaagaaacgacgaggagccgacacauccgucggcaucguaggacuccuccuuaccaccgccauggcggcggaggucacacgcagagggucagccuacuacauguaccuagaccgcaacgacgccggcgaagcgaucaguuuucccaccacgcugggaaugaacaaaugcuacauccaaaucauggaccuaggacacaugugcgacgccacaaugucauacgaaugccccaugcucgacgaaggcgucgaaccagacgacgucgacugcuggugcaacacgaccuccacaugggucguguacggaaccugucaccacaagaaaggcgaagcccgacgaucacgcagagccgucacccuacccucccacagcacccgcaaacuucaaaccagaucacaaaccuggcucgaaucccgagaguauacaaaacaccucauacgagucgaaaacuggaucuuccgcaacccaggauuugcccuggcggccgcugccauagccuggcuacucggcuccucaaccucacaaaaggucauauaccucgucaugauccuccuaaucgcccccgccuacagcauccgcuguauaggagucucaaacagagacuuuguagaaggaaugucaggcgggaccuggguugacgugguacuggaacacggcggcugcguaacugucauggcgcaagacaaacccacaguggacauagagcuaguaaccaccaccguaagcaacauggcagaaguacgcuccuacugcuacgaagcaucgaucuccgacauggccucagacucccgcugccccacccaaggcgaagcauaccucgacaaacaaucagacacccaauacgucugcaagcgcacccucguagaccgcggauggggcaacggcugcggccuguucgggaaaggcucccuaguaaccugcgccaaauucgcaugcagcaaaaagaugacuggcaaauccauccaacccgagaaccucgaauacagaaucaugcucucaguccacggaucccaacacuccggcaugauagucaaugacacgggacacgaaacagacgaaaaccgcgcgaaagucgagaucaccccaaacucaccccgagcagaagcaacccuuggaggauucggcagccuaggacucgacugcgaacccagaaccggccuagacuucuccgaccucuacuaucucaccaugaacaacaaacacugguuaguccauaaggaaugguuccacgacaucccccuccccuggcacgcaggcgcugacaccggcacaccccacuggaacaacaaagaggcacucgucgaguucaaggacgcccacgcaaaacgacaaacaguagucguacucggcucccaggaaggcgcaguacacacagcccuagcaggcgcacucgaagcggaaauggacggagcaaaagguaaacuuucaagcggccaccucaaaugccgacugaaaauggacaagcugcgccuaaaaggagucagcuacagucucugcacggccgcauucacauuuacaaaaauaccagccgaaacgcuacacggcaccgucaccgucgaaguccaauacgccggcaccgacggccccugcaaaguacccgcacaaauggccguagacaugcaaacccucacaccgguaggacgccucaucaccgcaaaccccgucauuacagaauccaccgaaaacucaaaaaugaugcucgaacuagaucccccguuuggugacuccuacaucgucaucggaguaggagaaaagaaaauaacacaccacuggcaccgcagcggaucgacaaucggaaaagccuucgaggcaaccgugcgcggcgcaaaacgaauggccguccucggagacaccgccugggacuucggcuccgucggcggggcacuaaacagccuaggaaaaggaauccaucagauauucggagcagccuucaaaucacuguucggaggcauguccugguucucccaaauacugauaggcacacuacucaugugguuaggccucaacaccaaaaacggaagcauaagccucaugugccucgcccucggcggcguccucauauuccucuccacagcggucuccgcagacgugggaugcagcguagacuucagcaaa

SEQ ID NO: 2877 - RNA, 2136 nt, Artificial Sequence
  KY014314.1 prME-long CDS opt
cgaaucaucaacgcacgcaaagaaaaaaaacggcgaggcgccgacaccagcguaggcauaguaggacuccuacuaacaacagccauggccgccgaaguaacccgacgcggcuccgccuacuacauguaucucgaccggaacgacgccggcgaagcaauauccuuccccacaacccucggcaugaacaaaugcuacauacaaaucauggaccucggccauaugugcgacgcaacaaugucauacgaaugccccaugcucgacgaaggcguugagccagacgacgucgacuguuggugcaacaccacaagcaccuggguagucuacggaacaugccaccauaaaaaaggcgaagccagacgauccaggagagcgguaacucugccaucacacuccacacgaaaacuacaaaccagaucccaaacauggcucgaaagccgcgaauacaccaagcaccucauccgcguagagaacuggauuuuccgaaaccccggauucgcccuagccgccgccgccaucgccuggcuucugggauccucgaccagccaaaaaguaaucuaccucgucaugauccucuuaauagcccccgcguacagcauacgaugcaucggaguaucgaaccgcgacuucguagagggaaugagcggcggcacauggguagacguaguacucgagcacggagguugcguaacagucauggcacaagacaaaccuacaguggacaucgaacucguaacgaccaccgucagcaacauggcggaagugcgcucauacugcuacgaagcaucgauaagcgacauggccuccgacucccgcugcccaacgcaaggcgaagccuaccucgauaaacaguccgacacccaguacgucugcaaacgcaccuuagucgacaggggauggggaaacggcugcggccuauucggcaaaggcagccuugucaccugcgccaaauucgcgugcagcaaaaaaaugacaggaaaauccauccaacccgaaaacuuagaguaccgcauaauguuaucaguccacggaucccaacacucaggaaugaucgucaacgauacaggccacgaaacagacgaaaaccgcgccaaagucgaaaucacacccaacuccccccgcgcagaagccacccuaggcggguucggaagccucggacuagacugcgagccccgcacaggacuugacuucagugaccuauacuaccuaacaaugaacaacaagcacuggcucguccacaaagaaugguuccacgacaucccccuacccuggcacgcaggagccgauaccggcacaccucacuggaauaacaaagaagcgcuagucgaauucaaagaagcacacgcaaaacgacaaacaguaguaguguuaggcucacaagaaggcgcaguccacaccgcgcuagccggagcccuagaagcggaaauggacggcgcaaaaggccgccuaucaagcggccaucuaaagugucgacuaaaaauggacaaacuccgacugaaaggcguauccuauagccugugcaccgccgcauucaccuucacaaaaauccccgcagagacccuucacggaacggucacuguagaaguccaguacgcaggcaccgacggaccaugcaaaguccccgcacaaauggccguugacaugcaaacccuaacaccagucggaagacucauaaccgccaacccagucaucacagaaaguaccgaaaacagcaaaaugaugcucgaacucgaccccccguucggcgacagcuacaucgugaucggcguaggcgaaaaaaaaauaacgcaccacuggcauagaucaggcagcaccauaggaaaagccuucgaagcaacaguacgcggcgcaaaacgaauggccguacucggcgacacggcaugggacuucggcuccgugggcggagcgcugaauagucugggcaaagguauccaccaaaucuuuggggccgcauuuaaaucccucuucggcggcaugucaugguucucacaaauccuaauaggaacacuucugauguggcugggacucaacacgaaaaacggcuccaucucccugaugugccuagcacucggcggcguacugauauuccuauccacagcagucucagcagacguaggcugcucggucgacuucagcaaa

SEQ ID NO: 2878 - RNA, 2136 nt, Artificial Sequence
  KU926310.1 prME-long CDS opt
cgaaucaucaacgcaaggaaagaaaagaaaagacggggcgcggacacaagcgucgggaucgucggucuacuacucacaaccgcaauggccgcugaagucacccgcagaggcagcgcauauuacauguaccuggacagaaaugacgcaggagaggcaaucagcuuccccacaacgcuaggcaugaacaaaugcuacauacaaaucauggaccuaggacacaugugcgaugcgacaaugagcuaugagugccccaugcucgacgaaggagucgaaccagacgaugucgacugcuggugcaacaccacaagcacgugggucguauacggcacaugccaccacaaaaagggcgaagcacgacgaagcagacgagccgucacacugccaucacacuccacacgcaaacuccaaacacggagccaaacauggcuggaaucccgggaauacaccaaacaccucauccgggucgaaaacuggauauucagaaacccaggauucgcccucgcagcugccgccauagcauggcuccuaggcucaagcacaucacaaaaagugauauaccuuguaaugauacuacucaucgcgcccgccuacucaauacgaugcauagggguaagcaaucgcgauuucguggaagguaugucagguggcaccuggguagacgucgugcucgagcacggaggauguguaacgguaauggcacaggacaaacccacggucgacaucgagcucgucaccacgacgguaagcaacauggccgaaguacgcucauacugcuacgaggcguccauaucagacauggcaucagacagccgcugccccacccagggagaggcauaccuggacaaacaaagugauacacaauacguaugcaaacggacgcucgucgacagaggcuggggcaacggauguggacuauucggcaaaggaagccuaguaacgugcgccaaauucgccugcagcaagaaaaugacaggaaaauccauacaaccagaaaaccuagaauaccgaauaaugcucucaguacacggcucacaacacaguggcaugauaguaaacgacaccggccaugaaacugacgaaaaccgcgccaaagucgaaaucacccccaacagcccgcgagcagaagcaacacucggaggauucggauccuuaggacucgacugcgaaccacgcacaggacucgauuucagcgaccucuacuaccucacgaugaacaauaaacauuggcuaguccacaaagaaugguuccacgacaucccccuacccuggcacgcaggcgccgacacaggaacaccccacuggaacaacaaagaagcacugguagaguucaaagacgcacacgccaaacgccagacagucgugguccuaggaucacaggagggggcaguccacaccgcacucgccggagcccuagaagccgagauggacggagccaaaggaagacucagcucgggccaccucaaaugcagacuaaaaauggauaaacuaagacucaaaggugucuccuacucccucuguacagccgccuucacauucaccaaaauaccagccgagacgcuacacggcaccguaacagucgaggugcaguacgcaggcgcggacggaccaugcaaggugccagcccaaauggccguagacaugcagacccucacaccgguaggccgacuaauaaccgccaaucccguaauaaccgaauccaccgaaaacucaaaaaugauguuagaacuggacccgcccuucggggacagcuacauagucaucggagugggagaaaagaaaaucacacaccacuggcacagaaguggaagcacaauagggaaagcguuugaggccaccguacgcggcgccaaacgcauggcaguccuaggagacaccgcaugggacuucggcagcgucggcggagcacucaacucacugggcaagggaauccaccaaauuuucggcgcagcauucaaaagccuauucggaggaaugagcugguucucacaaauacugaucggcacacuacuaauguggcugggacugaauaccaaaaacggaagcaucaguuuaaugugccuugcacuaggaggcguacugauauuccuaagcacagccgucuccgcagacguggggugcagcguagacuucagcaaa

SEQ ID NO: 2879 - RNA, 2136 nt, Artificial Sequence
  KU761560.1 prME-long CDS opt
agaauaauaaacgcagggaaagagaagaaacgaaggggagccgacacaaacgucggcaucgucggacuauugcuaacaacggcgauggcagccgaaguaacacgccgcggaucagcguacuacauguaccuggaccgaaacgacgccggagaagcaaucuccuucccaaccacgcucggcaugaacaaaugcuacauccaaauaauggaccuaggacacaugugcgacgccaccauguccuacgaaugcccgaugcucgacgaaggcgucgaaccagacgaugucgauugcugguguaauaccacgaguacaugggucgucuacggcacaugccaucacaagaaaggagaagcacgcagaagcagacgcgccguaacacuaccaagccauuccacaagaaaacuacagacaaggagccaaacauggcuggaaagccgcgaauacacaaaacaccuaaucagaguggaaaacuggaucuucaggaauccaggauucgcacuggccgcggcggcaauagcguggcuccuaggaagcaguacaucacaaaaaguaaucuaccucguaaugauauugcugaucgcgccagccuacucuauaaggugcauaggagucagcaaccgugacuucguagaaggaauguccggcggcaccugggucgacgucgugcucgaacacggagggugugucaccguaauggcccaagacaaacccaccguagacauagaacuggucacaacgaccguaagcaacauggcagaagugcgcagcuacugcuacgaggccucaaucagcgacauggcaagcgacucccgcugcccaacacaaggcgaagcauaccuggacaaacagagcgacacccaguaugucugcaaaaggacccucgucgaccgaggauggggaaacggaugcggccuauucggcaaaggaucccuagugacgugcgccaaauucgcaugcaguaagaaaaugaccggcaaaagcauacaaccagaaaacuuagaauacaggaucaugcucucagugcacggaucacaacacagcggaaugauagucaacgacaccggccacgaaacggacgaaaacagagccaaagucgaaauuacacccaacaguccacgcgcagaagcgacccucggaggguucgggagcuuaggacucgacugcgaaccacgaacgggacucgacuucagcgaccuguauuaccuaacaaugaacaacaaacauuggcuagugcacaaagagugguuccacgacaucccccuaccauggcacgccggggccgacacaggcacaccccauuggaacaacaaagaagcucuagucgaguucaaagacgcacacgcaaaaaggcaaaccgucgugguacuuggcagccaagaaggcgcaguccacacugcacuagcaggagcgcuagaagccgaaauggacggagcaaaaggccgccuauccucggggcaccucaaaugcagauugaaaauggacaaacuaagacugaaaggaguaucauacucccucugcaccgcugccuucaccuucaccaaaauacccgcagaaacccuccacggaacgguaacagucgaaguacaguaugccggaaccgacggccccugcaaggucccagcccaaauggccgucgacaugcaaacacuaaccccaguuggccgccuaaucacggccaacccaguaaucacagaaucaaccgagaacuccaaaaugaugcucgaacucgacccacccuucggagacagcuacaucguaaucggcgucggcgaaaagaaaauaacccaccacuggcaccgcagcggaagcacaauuggcaaagcguucgaagcaacggucagaggcgcacgcagaauggcaguucucggcgauacagcaugggauuucggcagcguaggaggggcgcucaacucccucgggaaaggcauacaucaaaucuuuggggcagcguucaaaagccuguucggcggcaugucaugguucagucaaauccuaauaggaacacuccuaauguggcucgggcuaaacacgaaaaacggguccaucagcuuaaugugccucgcacucggaggaguacucaucuuccuauccacagcuguaagcgcagacgucggaugcucaguggacuucucaaaa

SEQ ID NO: 2880 - RNA, 2136 nt, Artificial Sequence
  KY317939.1 prME-long CDS opt
cgcauaaucaacgccagaaaagagaagaaacgacgaggagcagaaaccagcguggggauagugggccugcuccuaaccacagcaauggcugccgaagugacacgaagaggaagcgccuauuacauguaccuggacagaaaagacgcaggagaagccaucagcuuuccaaccacacucgggaugaacaaaugcuacauccagauaauggaccuaggccacaugugcgacgcaaccaugucauacgaaugccccauguuagacgaaggcguggagccggacgacguagacugcuggugcaacaccaccagcacuugggugguguacggaacaugccaccacaagaaaggcgaagccagacgcagcagacgagccgucacgcuccccagccacuccacacggaaacuacagacacgaagccaaacauggcuagaaagccgcgaauacaccaaacaccuaaucagagucgagaacuggaucuuccgcaaucccggcuucgcauuagccgcagccgcaauagccuggcuacuaggcagcagcacaucccaaaaaguuaucuaucuugugaugauacugcuaauagcccccgcguacucaauccggugcaucggcgucucaaaccgggacuucguagaaggcaugucaggcggcaccugggucgacgucguacuagaacauggaggaugcgucaccguaauggcccaagacaaacccaccguagacaucgaacucgucacgacuaccgucaguaacauggcagaagugcgauccuacugcuacgaagccagcaucuccgacauggccuccgacagccgcugcccaacacaaggcgaagcauaccucgacaaacaaagcgacacacaauacgugugcaaacgaacccuagucgaccgcggaugggguaacggaugcggccucuucggaaagggcagccuagugaccugcgcaaaguucgcaugcagcaagaaaaugacaggcaaaaguauccagccagaaaaucuggaguacagaauaaugcuuucaguacacggaucacaacacucaggaaugaucgucaacgacacaggccaugaaacagacgagaaccgcgcgaaaguagaaauaacccccaacagccccagagcagaagcaacacucggaggguucggcagccuaggacucgacugcgaaccacgaaccgggcuagacuucagcgaccuauacuacuuaacaaugaacaauaaacacuggcucguucacaaagaaugguuccacgacaucccccuaccauggcaugcaggagccgacaccggaacgccccacuggaacaacaaggaggccuuaguagaguucaaggacgcacacgcgaagcgacaaaccguagucguccuaggaucccaagaaggagccguacacacagcacuggccggcgcccucgaagcagaaauggacggggcaaaaggccgacuaagcagcggccaccuaaagugcagacugaagauggacaaacugagacucaaaggcgucuccuacagccucugcaccgccgcauucacauucaccaagauaccagcggaaacacuacacggaaccgucaccguagaagugcaauacgcaggcacugacggccccugcaaagucccagcacaaauggcaguagacaugcaaacacucacaccaguaggacgacucaucaccgccaacccaguuaucaccgagucaacagaaaacucaaaaaugaugcucgaacucgacccgcccuucggcgacagcuacaucguaauaggagugggagaaaagaaaauaacgcaccacuggcaccggagcggcagcacaauaggaaaagcauucgaagcaacagucagaggcgccaaaagaauggccguccucggcgacacggcaugggacuucgggagcgucggaggcgcauuaaacucccuggggaaaggaauccaccaaauuuucggagccgccuucaaaagccuauucggcgggaugucaugguucagccaaauccucauugggacccuacuaauguggcuaggccugaacacgaagaacggaagcauaucacuaaugugccuagcacuagggggaguccuaauauuccuauccacggcgguaagcgcagacguaggaugcuccguagacuucagcaag

SEQ ID NO: 2881 - RNA, 2136 nt, Artificial Sequence
  KY075937.1 prME-long CDS opt
cgaaucaucaacgcgagaaaagaaaagaaaagacguggagcggacacguccgucggaaucgucggacuauugcuaacgacggcuauggccgcggaagucacacgcagaggcagcgccuacuacauguaccucgaccgcaacgacgcuggcgaagcgaucagcuuccccaccacccuuggaaugaacaaguguuacauccagauaauggacuuaggacacaugugcgacgccaccauguccuacgaaugcccuaugcuugacgaaggcgucgagccagacgacguggauugcuggugcaacacaaccagcacauggguaguauacggaaccugccaucacaagaaaggcgaagcccgaaggaguagacgagccguaaccuuaccaucgcacucaacacgaaaacuacaaacccgcucccaaacauggcuagaaucccgcgaauacacaaaacaccucauccgcgucgaaaacuggauauuccgcaaccccggauucgcacuagccgccgccgcaaucgccuggcuacucggaagcucaaccucgcaaaaagucauauaccucguaaugauacugcuaauagcaccggcauacuccauacgauguaucggcguguccaacagggacuucgucgaaggaauguccggaggaaccugggucgacgugguacuagagcacggaggcugcgucacagugauggcccaggacaaaccaacagucgacauagagcuagucacaacaaccguguccaacauggccgaaguaagguccuacugcuacgaagccagcauaagcgacaugguaucagauucgcgaugccccacccaaggcgaagcauaccucgacaaacaaagcgacacccaguacguaugcaaacgcacgcucgucgacagaggauggggcaacggaugcgguuuauucggcaaaggaagccuaguaaccugcgcaaaauucgccugcaguaagaaaaugaccggaaaauccauacaaccagaaaaccuagaauaccgcaucaugcucuccguccacggaucacaacacagcggaaugauagucaacgacacgggacacgaaaccgacgaaaacagggccaaaguagaaauaaccccaaacaguccccgugcagaagcaacacucggcggguucggcucacucggccucgacugcgaaccaagaaccggccuagacuucuccgaccucuacuaccuaacaaugaacaacaaacacuggcucguacacaaagaaugguuccacgacauaccccuaccauggcacgccggcgccgacaccggcacuccacacuggaacaacaaggaagcccucguagaguucaaagacgcacacgcuaaacgccaaaccgucguaguccucggaagccaggaaggagccguccacaccgcccuggcaggggcccuggaagcugaaauggacggagcaaaaggcagacucucaagcggccaccuaaagugccgacucaaaauggacaaacucagacuaaagggaguaagcuacagccucugcacagccgcauucacauucaccaaaaucccagccgaaacucuacacggcacagucaccguagaaguacaauacgccggaacagacggaccguguaaaguaccagcucaaauggccguggacaugcaaacacugacacccgucggaagacucauaaccgccaacccagucauaaccgaaucgaccgaaaacagcaagaugaugcuagaacuagacccgcccuucggagacagcuacaucguaaucggcguaggggaaaagaaaauaacccaccacuggcacagaucaggcuccacaauaggaaaagccuucgaagccacaguacgaggcgccaaacgaauggcuguauuaggugacacggcaugggacuuuggaucaguaggcggcgcccuaaacucacuaggaaaaggcauccaccaaaucuucggggcagccuucaagucgcucuuugggggcauguccugguucucgcaaauccucaucgggacccuccuaauguggcuaggacucaacaccaagaacgguucgauaucccugaugugccucgcucucggaggaguccucaucuuccucuccacugccgucagcgccgacguuggcugcucggucgauuucuccaaa

SEQ ID NO: 2882 - RNA, 2136 nt, Artificial Sequence
  LC191864.1 prME-long CDS opt
agaaucauaaacgcaagaaaagaaaagaaaagaagaggcgcggauaccaaugucggaaucgugggacuccuacuaacaacggcaauggcagcggaaguaacccgacgaggcagcgcauacuacauguaccucgacagaaacgacgcaggagaagcaaucagcuuccccaccacucuaggcaugaacaaaugcuacauccaaauaauggaccucgggcacaugugcgacgcgacaauguccuacgaaugccccaugcuggacgaaggcguagaacccgacgacgucgacugcuggugcaacaugacgagcacauggguaguauacgggacgugccaccacaagaaaggcgaagcacgacgaagccgccgggcaguaacccucccaagccacagcacgcgcaaacuacagacucgcucacaaaccuggcucgagagccgagaauacacaaagcaccuaauccgcguagaaaacuggaucuuccgaaaccccggcuucgcacuagcagcagcagcgauagcguggcuacugggcucaagcaccagucagaaagucaucuaccugguaaugauacuacuaauagcaccagccuacagcaucaggugcauaggcguaagcaaccgagacuucguagaaggaaugagcggaggcaccuggguggacgucguucucgaacacggagggugcgucacaguaauggcccaagacaaacccacaguggacaucgagcuaguaacaaccacagucagcaacauggcagaaguccgcucauacugcuacgaagccuccaucuccgacauggccagugacucacgcugcccaacacaaggagaagccuaccucgacaaacaaucagacacacaguacgucugcaaacgcacacuggucgaccgcggauggggaaaugggugcggacuauucggaaaaggaucccucguaaccugcgccaaauucgccugcaguaagaaaaugacaggcaaaucaauccagccggaaaaccuagaauaccgcaucaugcucagcguccacggcagccaacacagcgguaugauaguaaacgacacaggacacgaaacagaugaaaaccgcgcaaaagucgagaucacacccaacagcccccgcgccgaagcaacccuagguggguuuggcagccugggacuagacugcgaaccacgaaccggacucgacuucuccgaccuauacuaccuaacuaugaacaauaaacacuggcucguacauaaggaaugguuccacgacaucccacuaccauggcacgcuggagccgacaccggaaccccgcacuggaacaacaaagaagcgcucguagaguucaaagacgcacacgccaaacgacaaacagucguuguacucgguagccaggaaggagcaguacacacagcacucgccggagcacuagaagcagaaauggacggagcaaaaggacgacugagcagcggccaccugaagugcagacucaaaauggacaagcuccgccucaaaggagucagcuacagccucugcaccgccgcguucaccuucacaaaaauaccagcggaaacacuucacggaacgguaacaguggaaguacaauacgccggaacagacggacccugcaaagucccagcccagauggccgucgacaugcaaaccuuaaccccagucggccgccuaaucaccgcaaaccccgucaucaccgaauccaccgaaaacuccaaaaugaugcuggaacuagacccacccuuuggagacuccuacaucguuauaggaguaggcgagaaaaagaucacccaccacuggcaccgcuccggaagcacgaucggcaaagccuucgaagccaccguccggggagccaaacgcauggcaguacuaggagacacagcaugggacuucggaagcgugggcggggcccugaacagccuaggcaaaggaauccaccagauauucggcgccgccuucaaaagccuauucggcggcauguccugguucucgcaaauacuuaucggcacacuauuaauguggcucggacucaacacaaagaacggcucaaucagccuaaugugucucgcucugggaggaguccuaauauuccucagcacggcagucagcgcggacgucggcugcucagucgacuucuccaaa

SEQ ID NO: 2883 - RNA, 2136 nt, Artificial Sequence
  KX447517.1 prME-long CDS opt
cgcauaaucaacgcccgaaaagagaaaaagcgacgcggggccgacacgagcgucgguauaguaggccuacuucugaccacagccauggcggccgaagucacgcgccggggcagcgccuacuacauguaccuagaccgaaacgacgcaggagaagcaaucagcuucccaaccacgcuaggcaugaacaaaugcuacauacaaaucauggaccuaggucacaugugcgacgcaaccaugagcuacgaaugcccuaugcuagacgaaggagucgaacccgacgacguggacugcuggugcaacaccacaagcacaugggucgucuacggaaccugccaucacaaaaagggcgaagcacgcagaagccgacgcgccgucaccuugccaagccacagcacccggaaacugcaaacaagaagccaaacguggcuagaaagucgcgaauauaccaaacaucucauacgcgucgaaaacuggaucuuccgaaaccccggcuucgcacucgcagcggccgcaauagcauggcuccuaggguccagcacaagccaaaaaguuaucuaccucguaaugauccuacucaucgcuccagcauacuccauacgaugcaucggcgucagcaaccgagauuucgucgaaggaauguccggaggcaccuggguagacgucguacucgagcacggcggcugcgucaccgucauggcccaagacaaaccaacugucgacauagaacucgucaccaccaccgucucaaacauggccgaagugcgcagcuacugcuacgaagcgagcaucagcgacauggccagcgacuccagaugucccacucaaggagaagccuaccucgacaaacaauccgacacccaauacgugugcaaacgcacgcuagucgaccgaggauggggaaauggaugcggacucuuuggaaaagguucguuaguaaccugcgccaaauucgcaugcuccaaaaagaugacaggcaaaucaauacagccggaaaaccucgaauacagaaucaugcucagcguccacggcagccaacauagcggaaugaucguaaacgacacgggacacgaaacagaugaaaauagggcaaaagucgagaucaccccuaacaguccccgagccgaggcggcacuaggcggauucggaucacuaggacucgacugcgagccccgcacuggccuggacuucuccgaccucuacuaccucaccaugaacaacaaacacuggcuagugcacaaggaaugguuccacgacaucccccuacccuggcacgccggcgccgacaccggaacuccccauuggaacaacaaagaagcacuggucgaauuuaaagacgcacacgcgaaacgacaaacagucguaguacucggaucccaagaaggugccguccacacagcacuagccggagcgcuggaggcagagauggauggcgccaagggccggcucuccuccggccaccuaaagugucgucuaaaaauggacaaacuccgccuaaaaggcgugucguacagccuaugcaccgcagccuucaccuucaccaaaauccccgccgagacacuacacggaaccgucacagucgaaguccaauacgccggcacagacggcccgugcaaagugccggcccaaauggcaguggacaugcagacccuaacaccagucggacggcuaaucacagccaaucccguaaucacagaaagcacagaaaacagcaaaaugauguuagaacuagaucccccauucggcgacagcuacauagucauaggcgucggagagaagaaaauaacacaccacuggcacagaagcggcagcacaaucggaaaagcauuugaagcaaccguccgcggagcaaaaagaauggcaguacugggcgacaccgcaugggacuucggaucaguaggcggcgcacuaaacucauuaggcaaagggauacaccaaauauucggagcugcauucaaaagccucuucgggggcaugagcugguucucacaaacacucaucggcacccuacugauguggcugggacuaaauaccaaaaacggaagcaucucgcucaugugccucgccuuaggaggaguccuaaucuuccucagcaccgcuguaagcgccgacgucggcugcagcgucgacuucucaaaa

SEQ ID NO: 2884 - RNA, 2136 nt, Artificial Sequence
  KU922923.1 prME-long CDS opt
cgcauaaucaaugccaggaaagaaaagaaaaggcgcggcgcagaaaccucagugggaaucgucggacuacuacugaccacagcaauggccgccgaggugacacgacgcggaucugccuacuacauguaccuagaccgaaacgacgcuggcgaagcgaucuccuuccccacaacccucggaaugaauaaaugcuacauacaaauaauggaccuaggccacaugugugacgccacaauguccuacgaaugcccaaugcucgacgaagguguggaacccgacgacguggacugcuggugcaacacaacgucaacguggguaguauacggaaccugccaccacaagaaaggagaagcaagaagaagccgacgagcuguaacacucccgagccacagcacgcgaaaacuccaaaccagaagccaaacguggcuagaaagcagagaauacaccaaacaccuaauacgcgucgagaacuggauauuucgaaaccccggauucgcacucgcagccgccgcaauagccuggcuacuaggcaguucaaccagucaaaaagucaucuaccuaguuaugauacuacucaucgcacuagcauauagcauccgauguauaggggucucaaaccgcgacuucguagagggaaugagcggcggcaccuggguagacgucguccucgaacacggcggaugcguuaccguaauggcgcaggacaaacccaccguggacauagagcuaguuaccacgacaguaagcaacauggcggaagucagaucauacugcuacgaagcaagcaucagcgacauggcaagcgacagcagaugcccaacgcaaggagaagccuaccucgacaaacagagcgacacacaauacgucugcaaacgcacgcuuguagaccgaggauggggcaacggaugcggacuguucggaaaaggcucauuagucacaugcgccaaauucgcgugcagcaagaaaaugaccggaaaaaguauccaacccgaaaaccucgaauaccgaaucaugcucuccguccacggaucacagcacagcggaaugauaguaaacgacacaggacacgaaaccgaugaaaaccgggcgaaaguagaaaucacuccaaacuccccuagagcggaagccacacuaggcggcuucggaagccuaggccucgacugcgaaccacgcacgggccucgacuucagcgaccucuacuaccuuaccaugaacaacaaacacuggcugguacacaaagaaugguuccacgacaucccccuaccauggcacgcaggagcagacacaggcacaccccacuggaacaauaaagaggcacucgucgaguucaaagacgcccacgcaaaacgacaaaccgucgucguccuaggaagucaagaaggcgcgguccacacggcacucgccggugcgcuagaagcagagauggacggcgcgaaaggacgacuaagcuccggacaucucaaaugcaggcucaaaauggacaaacuccggcugaaaggaguaagcuacucgcucugcaccgcugccuucacauucaccaaaauccccgccgaaacacuccacggcaccgucaccgucgagguacaauacgcaggcacagauggaccgugcaaagucccagcacaaauggccguagacaugcaaacacugacacccgucggacgacucaucaccgcuaaccccgucaucaccgaaaguaccgagaacagcaaaaugaugcuagaacucgacccgcccuucggagacucauacaucguaaucggagucggggaaaagaaaauaacacaccauuggcaccgauccggcuccacuauaggaaaagcguucgaagccacgguacgcggugccaaacgaauggcaguccucggcgacaccgccugggacuucggaagugucggaggcgcauuaaacucccucggcaaaggaauacaccaaaucuucggcgccgcauucaaaagccuauucggaggaauguccugguucucccaaauacugauagggacacuccucauguggcucggucuaaacaccaaaaacggaagcaucucccucaugugccuugcccuuggaggaguacucaucuucuugucaacagccguaagugcugacgucggcugcagcgucgacuucuccaaa

SEQ ID NO: 2885 - RNA, 2136 nt, Artificial Sequence
  KY003156.1 prME-long CDS opt
cgaaucauaaacgcuaggaaagagaagaaacggcgaggagcggacacauccgugggaauaguuggccugcuccuaacaaccgcaauggcggcagaaguaacgcgccgaggcuccgccuacuacauguaccuagaccguaacgaugcuggggaggcaauauccuucccuaccacccucggcaugaacaaaugcuacauccaaauaauggaccucggacacaugugcgacgccacaauguccuacgagugcccgaugcuagacgaaggcgucgaaccagacgacgucgacugcuggugcaauacaaccagcaccugggucguauacggcacuugccaccacaagaaaggagaagccagacgcagcagacgagccgucacgcucccaagccacuccacccgcaaacuacagacccgaucccaaacauggcucgaaagccgagaauacacaaaacacuuaauccgcgucgagaacuggaucuuccgcaaccccggcuucgcacucgcagcggccgccauagccuggcuccucgggagcagcaccucccagaagguaaucuaccuggugaugauacuccuaauugcacccgccuacuccauacggugcauaggcauauccaaccgagacuucgucgaaggcaugucaggaggaaccugggucgacgucguucuagaacacggaggcugcguaaccgucauggcccaagacaaaccaacagucgacauagagcuagucaccacaaccgucuccaacauggccgaagucagaaguuacugcuacgaggcaagcaucagcgacauggccagcgacagccgcugccccacacaaggagaagcauaccucgauaaacaaucagacacccaauacgucugcaaacgcacacugguagacagaggauggggcaacggcugcggucucuucgggaaaggcucacugguaaccugcgccaaauucgccugcuccaagaaaaugacagggaaauccauacaaccagaaaaccuagaauaccgcauaaugcuaucuguccacggaucacaacacuccggcaugauaguaaacgacaccgggcacgaaaccgacgaaaacagagccaaaguagaaaucacccccaacagcccccgcgcggaagcaacacucggaggauucggcauacuaggacuggacugcgaacccagaaccggacuggauuucagcgaccuuuauuaccucacaaugaacaauaaacacuggcugguccauaaagaaugguuccacgacauacccuuacccuggcaugcgggagcagacacaggcacaccgcacuggaacaauaaagaagcccucgucgaguucaaagacgcccacgcaaaaaggcaaaccgucguaguccugggcucccaagaaggagccguacacaccgcacucgccggcgcccuagaagcagagauggacggggccaaaggccgacuaagcuccggccaccucaaaugccgucuaaaaauggacaaacuacgcuuaaagggcgugucauacucacucugcacagcagccuucacauucaccaaaauaccggcagaaacacugcacggcacagucacaguggaagugcaauaugccggcacagacggcccauguaaagucccagcccaaauggcaguagacaugcaaacgcuaacaccagugggccgccuaauaacagccaaccccgucaucacagaaaguacagaaaacucaaaaaugaugcuagagcuagaucccccauuuggcgacucauacauaguaauaggcgucggcgaaaagaaaaucacccaucacuggcaccgaucaggaagcacaauuggaaaagccuucgaagcgacaguaagaggagccaaacgaauggcaguacugggagacacagccugggacuucggaagcgugggcggagcacugaacucgcuaggaaaaggcauccaccagaucuucggcgcagccuucaagucacucuucggcggcaugagcugguucucccagauacucaucggcacgcuccucauguggcuaggacuaaacacgaaaaacgguagcaucucacugaugugccucgcccucggaggaguccucauauuccuaucgacagccguaagugccgacgugggaugcuccgucgacuucuccaaa

SEQ ID NO: 2886 - RNA, 2136 nt, Artificial Sequence
  KU312313.1 prME-long CDS opt
cgcaucauaaacgccagaaaagaaaagaaaaggcguggcgccgacacauccguaggaauagucggucuacuacucaccacagccauggcagccgaagucacaaggagaggcucagcauacuacauguaccucgaccgcaacgaugccggagaggccauuucauucccaacaacccuaggaaugaacaaaugcuacauccaaauaauggaccucggccauacaugcgacgccacaauguccuacgaaugcccuaugcucgacgaaggaguagaaccggacgacgucgacugcuggugcaacaccaccucaaccugggucguguacggaacaugccaccacaagaaaggagaagccagacgcagccgccgggcagugacccuccccucccacucgauccgcaaacuccaaacacgcagccaaaccugguuagaaucacgagaauacaccaaacaucuaaucagggucgaaaacuggaucuuccgaaacccaggcuucgcacucgccgcagccgcaauagcgugguuacucggaagcuccacaagccaaaaagucaucuaccucguaaugauacuucuaauagcaccagccuacagcauccgcugcaucggagucagcaaccgagacuuugucgagggcaugagcggcggcaccuggguggacgucguacucgaacacggcggcuguguuacggucauggcccaggacaagcccacagucgauauagaacucgucacuacaaccgucagcaacauggcugaaguacgaagcuacugcuacgaggccuccauaagcgacauggcaagcgacucccgcugccccacccaaggcgaagcauaccuugauaaacaauccgacacacaauauguaugcaaacgcacacucguagacagaggguggggaaacgggugcggacucuucggcaaaggaucccucguaaccugcgccaaauucgccugcuccaaaaagaugaccggaaagagcauccaacccgaaaaccucgaauaucggaucaugcucuccguccacggaucccaacauagcggaaugaucguaaacgacacagggcacgaaaccgacgaaaaccgcgcaaaaguagaaaucaccccgaacagcccccgcgcggaagccacccucgggggcuucggaagccugggccucgacugcgaaccccgaacaggacuagacuucuccgaccucuacuaccuaaccaugaacaacaaacacuggcucguccacaaagaaugguuccacgacauaccccuaccauggcacgcaggcgccgacacgggcacaccgcacuggaacaacaaagaggcauuagucgaauuuaaggacgcgcacgcaaaacgccagacaguagucgugcugggcucacaagaaggcgccguacacaccgcccuugccggcgcacuagaagcagagauggacggcgcaaaaggcagacuauccuccggccaccuaaaaugcagacuaaagauggacaaacuccggcugaaaggaguguccuacagccuuugcaccgcugccuucacguucacaaaaauccccgccgagacccuccacggaacgguaacaguagagguccaguacgcaggcaccgacggaccgugcaaagucccagcccaaauggccgucgacaugcaaacgcucacccccgucggccgacugauaaccgcgaacccagucaucaccgaguccaccgaaaacuccaaaaugaugcuagaacuagacccaccauucggggacucauacaucgugauaggaguaggcgaaaagaaaaucacccaccacuggcaucguuccggcuccacaaucggcaaagcauucgaagccacagucagaggcgccaaacgaauggccgugcucggagacaccgccugggacuucggaagcguaggcggcgcccucaacucccucggaaaaggaauccaccaaaucuucggggccgccuucaagucccucuucggcggaaugucaugguucucucagauacucaucggaacucugcucauguggcuagggcuuaacgccaagaauggcucgaucucacucaugugccuagcauuaggaggaguccucauauuccuaagcaccgcgguauccgcagacguagggugcagcgucgacuucaguaaa

SEQ ID NO: 2887 - RNA, 2136 nt, Artificial Sequence
  KY075935.1 prME-long CDS opt
cgaauaauaaacgccagaaaagaaaagaaacgacgaggagccgacaccucaguaggcaucguaggacuacuacucacgacagcaauggcagcagagguaacccgccgcgggagugcauacuacauguaccuugacagaaacgacgcgggagaagcgauauccuucccaacaacgcucgggaugaacaaaugcuacauccaaauaauggaccucgggcauaugugcgacgcaacaaugucguacgaaugcccaaugcuagacgaaggcguagaaccagacgacgucgacugcuggugcaacacaaccagcaccugggucguauacggcacgugucaccacaagaaaggagaagcccaacgcuccaggcgagccgucacgcuccccagccacagcacccgaaaacuccaaacccgcagccagacauggcucgaaucaagagaauacaccaaacaccuaauacgagucgaaaacuggaucuuccgcaaccccggauucgcccucgcagccgcagcgauagcguggcuccugggcagcaguaccagccagaaaguaauauaccuugucaugauacuccucauagcccccgccuacaguauacgcugcauaggcguaagcaaccgcgacuucguagaaggaaugagcggcggaacaugggucgacguggucuuagaacacggcggcugugugacaguaauggcacaagacaagcccaccguagacauagaacuggucacaacaacaguaagcaacauggcagaaguccgcucguacugcuacgaggcuucaaucuccgacauggcaucagacucaaggugcccaacucaaggagaagcauaccucgacaaacaauccgacacccaauacgucuguaaacgaacacuugucgaccgcggaugggggaacggaugcggccucuucgggaaaggaucccucguaaccugcgccaaauucgcgugcucgaagaaaaugacgggaaaaagcauacagcccgaaaaccuugaauacagaauaaugcucagcguccacggaucacaacacagcggcaugauagucaacgacacaggccacgaaaccgaugaaaaccgggccaaaguagaaaucacgccaaacuccccacgagccgaagcgacacucggaggcuucggaucccuggggcuagacugcgaaccucgaacaggcuuggacuucagcgaccuguacuaccuaacaaugaacaacaaacacuggcugguacacaaagaaugguuccacgacaucccacuccccuggcacgccggagcagacaccggaaccccucacuggaacaacaaagaagcacucgucgaguucaaagacgcacacgccaaaagacaaacaguagugguccucgggagccaagaaggagcaguacacacagcccucgcaggcgcccucgaagcagagauggacggagcaaaaggacgccugagcucaggacaccuaaaaugcagacuaaaaauggacaaacuccgacuaaaaggcgucucuuacucacuauguacagcagcguuuaccuucacaaaaaucccagcggaaacauuacacggaaccgucaccgucgaaguacaauaugccggaaccgacggcccaugcaaaguccccgcacaaauggcagucgacaugcaaacacucacccccgucggacgccugaucacagcgaacccaguaaucaccgagucaacggagaacagcaaaaugaugcuagagcuggacccgccauuuggagauuccuacauagucaucggcgucggagagaagaaaaucacacaccacuggcaucgcagcggaagcacaauagguaaagcauucgaagcgacaguccguggagcaaaaaggauggcgguccucggcgauaccgcaugggacuucggcagcguaggcggagcccuaaacagccucggaaaaggcauacaccaaaucuucggcgccgccuucaaaagccuauucggcggaaugagcugguucagccaaauccuaauaggcacacuccucauguggcucggccucaacaccaaaaacggaagcaucagccucaugugccuagcccucggcggcguccuaaucuuccugucaacagccgugagcgcagacgucggcugcagcguggacuucucaaaa

SEQ ID NO: 2888 - RNA, 2136 nt, Artificial Sequence
  KY014320.1 prME-long CDS opt
cgcauuaucaacgcgcgaaaagagaaaaagagacgaggcgcagacaccuccguaggcaucgucggccuacugcucaccaccgccauggcagcagaagucaccagaagagguucagcguauuacauguaccucgaccgaaacgacgcaggggaagcaaucagcuucccaaccacccuaggaaugaacaagugcuacauacaaaucauggaccugggacacaugugcgacgccaccaugucauacgaaugcccgaugcucgacgaaggaguagaacccgaugacgucgacugcuggugcaacaccaccagcaccuggguagucuacggaaccugccaccacaagaaaggcgaagcacgacgcucgcgcagagcagucacccucccaucacacucaacaagaaaacuacaggccagaucacaaacauggcucgaaucccgagaguauaccaaacaccugauccgcgucgaaaacuggauauuccgaaaucccggcuucgcacuggccgccgccgccauagccuggcugcucggcagcagcaccagccaaaaagugaucuaccucgucaugauacugcucauagccccagccuacucaauacgcugcauaggaguaucaaacagagacuucgucgaggggaugucaggaggcaccuggguagacgucguccucgaacacggcggaugcgugacagucauggcccaggacaaacccacaguagacaucgagcuagucacaacaacagucucaaacauggccgaaguucgcucauacuguuacgaagccagcaucagcgacauggcgagcgacucacgcugcccgacccaaggagaagccuaccuggacaaacaguccgacacgcaguacgucugcaagagaacccuaguagacaggggcuggggcaacggcugcgggcuauucgggaaagguagccuuguaaccugcgccaaauucgccugcuccaagaaaaugaccggcaaaucgauccagcccgaaaaucuagaauaccgcauaaugcucuccgugcacggcagccaacacucaggcaugauuguaaacgacacuggccacgagacggacgaaaaccgcgcaaaagucgaaaucacaccaaacuccccacgcgcggaggcaacccucggaggcuucggaagccuaggccucgacugugaaccccgcaccggccuagacuucucagaccuuuauuaccucacaaugaacaacaaacacuggcucguucacaaagaaugguuucacgacaucccgcuccccuggcacgcaggcgccgacacaggaacaccccacuggaacaacaaagaagcccuagucgaguucaaagacgcacacgcaaaacgccaaaccgucgucguacucggcucgcaagaaggagcaguacacaccgccuuggcaggcgcccucgaagccgaaauggacggcgccaagggccggcucagcuccggccaccucaaaugccgccuaaaaauggacaaacuacgacuaaaaggaguaagcuacagccuaugcaccgcugcauucacuuucacaaaaauacccgcagaaacccuacacggcaccgucacggucgaaguucaauacgccggcaccgacggacccugcaaagucccagcccaaauggcaguagacaugcagacacucaccccagucggaagacuaaucaccgcaaacccaguaauaacagaauccaccgaaaacagcaaaaugaugcucgaacucgacccgccguucggagacagcuacaucguaaucggcguaggcgaaaagaaaauaacacaccacuggcaccgauccggcuccaccaucggcaaggccuucgaagcaaccguacgaggagccaaacgaauggcaguacucggagauacggcuugggauuucggcagcgucgggggagcccuaaacucacuaggaaaaggcauccaucaaaucuucggagcggcuuuuaaaagucuauucggaggcaugaguugguucagccagauacuaaucggcacacuacuaauguggcucggccucaacaccaaaaacggauccaucucacuaaugugucucgcccuaggcggaguacuaauauuccucagcaccgccgucagcgccgacguaggaugcaguguggacuucucaaag

SEQ ID NO: 2889 - RNA, 2136 nt, Artificial Sequence
  KX827309.1 prME-long CDS opt
cgcaucaucaacgcgcgcaaggagaagaaacgccgaggcgcagacacauccgucggaaucguagggcuacuccucacaaccgcaauggccgcagaagugacacgacgcggaucugcauacuauauguaccuagacagaagcgacgcaggagaagcaauuagcuucccaacgacccucgggaugaacaaaugcuacauacaaauaauggaccucggacacaugugcgacgcaacgaugucuuacgaaugccccaugcuagacgaagggguggaacccgacgacgucgacugcuggugcaacaccacaagcacguggguagucuacggaaccugccaccacaagaaaggcgaagcccgcaggagcaggagagccguaacacuccccucccacagcacccgaaaacugcaaacgagaucacaaacguggcucgaauccagagaauauacaaaacaccuaaucagagucgagaacuggauauucagaaacccagguuucgcccuagcagcagcagcaauagccugguuacuaggaagcagcaccagccaaaaaguaauauaccuaguaaugauacuccucauagccccagcauacagcauacgguguaucggaguaagcaaccgagacuucgucgaaggaaugucgggaggaacauggguagacguaguacucgaacacggcggcugcguaacagucauggcccaagacaaaccaacaguagacauugagcuagugacuacaacagucagcaacauggcggaaguccgcucguacugcuacgaagcaucgaucagcgacauggcaagcgacaguagaugccccacacagggcgaagccuacuuagacaaacaaucagacacccaauacguauguaaaaggacccuagucgaucgcggauggggcaacggaugcgggcuauuuggcaaagguucacucguaaccugcgcgaaauucgcgugcaguaagaaaaugacaggcaaaaguauacaaccagaaaaccucgaguaccgcauaaugcuaucgguccacggcucccaacacagcggcaugaucgucaacgacacgggacacgaaaccgacgaaaacagagcaaaagucgagaucacaccaaacucaccacgagcagaggcaacccuuggcggauucggcagucucggacucgacugcgaaccgcggacaggccucgacuucucagaccuauauuaccuaaccaugaacaacaaacacuggcuaguacacaaagaaugguuccacgacauaccacuaccauggcacgccggcgccgacaccggcacaccacacuggaacaacaaagaagcacucguagaguucaaagacgcgcacgcgaaacgacaaacaguaguaguacuaggcucacaagaaggagcaguccacacagcacuggccggcgcacuagaagccgaaauggacggcgcaaaaggacgucuaaguagcggucaccuaaaaugccgacuaaaaauggauaaacuacgccuaaaaggggucucauacucgcucugcaccgcagcauucaccuuuacgaaaaucccagccgaaacccugcacgggacaguaaccguagaaguccaauacgccggcaccgacggcccaugcaaaguaccagcccaaauggccgucgacaugcaaacccugaccccggugggaagacugaucacagccaacccagucaucacagaaagcacggagaacagcaaaaugaugcuggaacuugacccacccuucggcgacagcuacaucguaauaggggugggagaaaagaaaauaacacaucacuggcaccgcucagguagcacaaucggcaaagcauucgaggcaacagucagaggagcaaaacggauggcaguccuaggagacacagccugggauuucggaagcguaggaggggcgcucaauucacuaggcaagggcauccaccaaauauucggagccgccuucaagucacuguucggcggaaugagcugguucagccaaauccucaucggcacacuauuaaugugguuaggacugaacacuaaaaacggauccaucagccucaugugccucgcgcugggcggcguacugauauuccugagcacagccguaagcgccgacgucgggugcucaguagacuuuucaaaa

SEQ ID NO: 2890 - RNA, 2136 nt, Artificial Sequence
  KU681081.3 prME-long CDS opt
cgcauaauaaacgccagaaaagaaaagaagagaaggggaacagacacauccgugggcaucgucggccuccugcucacaacagccauggcagccgaagucacccgaagaggcagcgcauacuacauguaccuagacaggucagacgcaggcgaagcaauauccuucccaacaacacuaggaaugaacaaaugcuacauccagauaauggacuuaggacacaugugcgacgcaacgaugucauacgaaugccccauguuagacgaaggaguugaaccagacgacguggacugcuggugcaacacuacaucaacgugggugguguacggaacaugccaccacaagaaaggagaagcgcgcagauccagacgagcagugacccuaccaagccauagcacccgaaaacuccaaacaagaagccaaaccuggcuggagagcagggaauauaccaaacaccucauaagggucgagaacuggauauucagaaacccaggcuucgcacucgccgcagcagccauagccuggcuccuaggcucaagcacaagccaaaaaguaauauaucucgugaugauccuacuaaucgcaccagcauacucaauacgcugcaucggcgucaguaacagggacuucguagaagggaugucgggaggcacauggguggacguuguacucgagcacggaggaugcgucaccgucauggcacaagauaaacccacaguggacaucgaacucguaacuaccacagugucuaacauggcagaaguacgaucauacugcuacgaagcgucgauaucagacauggccagugacucccggugcccgacacaaggagaagcauaccucgacaaacagagcgacacacaauacguauguaaaagaacgcugguagaccgcggauggggcaacggcugcggacucuucggcaaaggaucccucguaaccugcgcaaaauucgcgugcucaaagaaaaugaccggaaagagcauacaaccagaaaaccucgaguaccgcauaaugcucucaguccacggaagccagcacagcgggaugauagucaacgacacaggccacgaaacagacgaaaaucgagcaaagguagaaaucacaccgaacagcccccgcgccgaagccacgcuaggaggauucggcucccuaggacucgacugugaaccgcgcacaggacuagacuucuccgaccuauacuaccucacaaugaacaacaaacacuggcuagugcacaaggaaugguuccaugacauaccccuccccuggcacaccggagccgacaccggaacaccacacuggaacaacaaagaagcccugguagaguucaaagacgcacacgcaaaaagacaaacaguagugguccuaggcagucaagaaggcgcuguacacacagcacuagcaggagcacuagaagccgaaauggacggcgcaaaaggaagacugucgucaggacaccucaagugccgauuaaaaauggacaaacuaagacugaaaggagucucguacagccucuguaccgcggccuucacauucaccaagauaccagccgaaacacugcacggaacaguaacaguagaagugcaguacgccgggacggacggaccaugcaaagugccagcacaaauggccguagacaugcaaacacucacgccagucggccgccugaucaccgccaaccccgucauaacagaagggaccgagaacucgaaaaugaugcuggaguuggacccacccuucggagacagcuacaucguaaucggagugggcgagaaaaagauaacgcaccacuggcaccgcaguggaagcaccaucggcaaagccuucgaagccaccguccgcggcgcaaagagaauggcaguccuaggcgacacagcaugggacuucggaagcguaggaggcguucugaacagccuaggcaaaggaauccaccaaaucuucggcgcagccuucaaaucacucuucgggggcaugucaugguucagccaaauacuaauaggcacccuacucauguggcucgggcuaaacacuaaaaacggaagcaucagccuaaugugccucgcccugggaggcguacuaaucuuccuaagcacagcaguuucagccgacgugggaugcagcgucgacuucucaaag

SEQ ID NO: 2891 - RNA, 2136 nt, Artificial Sequence
  KU744693.1 prME-long CDS opt
cgaauaauuaacgcuagaaaagaaaagaaaagacgaggagccgauacauccguagggauugucggacuacuccuaacaacagcgauggcggcagaagugacacggcguggcagcgccuacuacauguaccuggaccgaaacgacgcaggcgaagccaucucauucccaacaacacuuggcaugaauaaaugcuacauccaaauaauggaucuaggccacaugugcgacgcgacaaugagcuacgaaugcccaaugcuagacgaaggcgucgaacccgacgacguggacugcuggugcaacaccaccuccaccugggucguguacgggaccugccaccacaagaaaggagaagcccgacgcucaagacgcgcgguaacacuaccaucacacucaacccgaaaacugcaaacccgcagucagaccuggcucgagucgcgagaauacacaaaacaccugauacgaguagaaaauuggaucuuccgaaacccgggauucgcccucgccgccgccgcaaucgccuggcuccuaggauccuccacaagccaaaaagucaucuaccucguaaugauccuccuaaucgcaccagccuacagcauaagaugcauaggaguaagcaauagagacuucgucgaaggaaugucaggcggcacauggguagacgucguacuagagcacggaggaugcgucaccgcaauggcccaagacaaaccaacaguagacaucgaauuagucacaacaacaguguccaacauggcagaaguacgcucauacugcuacgaagccagcaucagcgacauggcgagcgacucccggugccccacgcaaggcgaagccuaucucgacaaacagucagacacccaauacgucugcaaacgaacuuuaguugaccgcggcuggggcaacggaugcggccucuucggcaaaggaucacucgucacgugcgcgaaauucgccugcagcaagaaaaugacagggaaaucaauucagccugaaaaccuagaauaccgcaucauguuaagcguccacggaucacagcacuccggcaugcucgugaaugauacaggccacgaaaccgacgaaaauagagcgaaagucgaaaucaccccgaacucuccacgggcagaagcaacacuaggcggcuucggcucccucggacucgauugcgagccccgcaccggacucgacuuuagugaccucuacuaccucacaaugaacaacaaacacuggcucgcacacaaagaaugguuccacgacaucccgcuacccuggcacgccggagcagccaccggcacaccccauuggaauaacaaagaagcacucgucgaguucaaagacgcacacgcgaaacgccaaacagucguagucuuaggaagucaggaaggcgccguccacaccgcucucgccggcgcccucgaagccgaaauggacggcgccaaaggccgacucuccagcgggcaccuaaaaugccgacucaaaauggacaaacucagacucaaaggcguaucauacagccucugcacagcagcauucaccuucacaaaaauccccgcugaaaccguugacggcacaguaaccguagaaggccaauacgggggcaccgacggccccugcaaaguccccgcgcaaauggcgguagacaugcaaacccucacgcccguaggccgccucauaacagccaaccccgugaucacagaaucaacggaaaacagcaaaaugaugcuagaacuggaucccccauucggagacucauacauagugaucggugucggagaaaagaaaaucacccaccacuggcaccgcucaggcucaacaauuggaaaagccuucgaagcaacagucagaggcgcaaaacgcauggccguccugggagacacagccugggacuucggcucagugggcggcgcccucaacucccucgggaaaggcauccaccagaucaucggagcggccuucaaaagccuauucggcggaaugucaugguucagccaaauacuaauaggaacacuacuaauguggcuaggacucaacaccaaaaacggcaguaucucacucaugugccuagcccucggcggagucuuaaucuuccucucaacagcuguaucaggcgggguaggcugcuccguagacuucuccaag

SEQ ID NO: 2892 - RNA, 2136 nt, Artificial Sequence
  KY328290.1 prME-long CDS opt
cgaaucauaaacgcacgcaaagaaaagaaacgacgagggacggacaccuccgucggaaucguaggccuccuucugaccaccgcaauggccgccgaagucacccgccgaggcucugcauacuacauguaccucgaccgcagcgaugccggagaagcgaucucauuccccacaacacucggcaugaacaaaugcuacauucaaaucauggaccucggacacaugugcgacgccacaauguccuacgaaugccccaugcuagaugaaggcgucgaaccagacgaugucgacugcuggugcaauacaaccagcaccugggucguguacggcacaugccaccacaagaaaggggaagccagacgcagccgacgagcagucacacuaccgucacacagcacacguaaacuccaaacccgcagccaaacauggcuggaguccagagaguacaccaaacaccugauaaggguagaaaacuggauauuccgcaacccuggcuucgcccucgccgccgcagcaaucgccuggcuacucggcucaucgaccucccaaaaaguaaucuaccucgucaugauacuucucaucgcccccgcauacuccauccgaugcauaggaguguccaaccgcgacuucguggaaggcauguccggcggaaccugggucgacguaguacuagaacacggaggaugcguaacggucauggcacaagacaaacccacaguugauauagagcucguaaccaccaccgucagcaacauggccgaaguacgcucauacugcuacgaagccuccaucucggacauggcuagcgauucccgcugccccacacaaggagaagcguaccuggacaaacaaucggacacacaauacguaugcaaacggacccuagucgaccgcgguuggggcaacggcugcggacuuuucggaaaaggaagccucguaacaugcgccaaauucgcaugcucgaaaaagaugaccggcaaaagcauacaaccagagaaccucgaguacagaauaaugcucucaguccacggcucccagcacuccggcaugauugugaaugacacgggccacgaaaccgacgagaaucgcgcuaaggucgaaaucacacccaauucaccacgcgcggaggccacacucggcggguuuggaagccucggccucgacugcgaacccagaacaggacuagacuucagcgaccuguacuaccucaccaugaacaauaaacacuggcuaguccacaaagaaugguuccacgacauccccuuaccauggcaugcaggcgccgacaccggcacaccccacuggaacaacaaagaagcccucguagaguucaaagacgcacacgccaaacgacaaacaguagugguacugggaucucaggaaggagccguacacacagcccuagcaggcgcauuagaagccgaaauggacggagccaaaggucgccucucuagcggacaucucaagugccgccugaaaauggacaaacucagacuaaagggagucucuuacucauuaugcaccgcagccuucacauuuuccaagaucccagccgaaacacugcacggcaccgucaccgaggaaguacaguacgccggaaccgacggcccaugcaagguaccagcccaaauggcggucgacaugcaaacacuaacccccgucggccgacucauuacagcuaaccccguuaucacagaaucaaccgaaaacucgaaaaugaugcuagaacuagacccacccuucggagacuccuacaucgucaucggcguaggcgaaaagaaaauuacacaccacuggcaccgcaguggcagcacgauaggaaaagcauucgaagcaacuguccgcggagccaaacgcauggcaguccucggggacaccgcaugggacuucggaagcgucggaggcgcccucaacucgcucggaaaaggaauccaccaaauuuucggagcagcguucaagucccuguucgggggcaugagcugguucagccaaauacucauaggaacacuacucaugugguuaggcuuaaacacuaagaauggcagcaucagccucaugugccucgcccuaggcggaguacucaucuuccucagcacagccgugagcgccgacguaggcugcagcgucgacuucucaaaa

SEQ ID NO: 2893 - RNA, 2136 nt, Artificial Sequence
  KX694532.2 prME-long CDS opt
cgcauaaucaacgcccggaaagaaaagaaacgacgaggcacugacaccuccgucggaauagucggacuacuacuaacuacagccauggccgcagaagucacaaggcgcggaucagcauacuacauguaccuagaccgcucagacgccggcgaagccaucagcuucccaaccacacuaggaaugaacaaaugcuacauacagauaauggaccugggacacaugugcgacgccacaaugagcuacgaaugcccaaugcuagacgaaggcguugaacccgacgacguagacugcugguguaacacgaccagcaccugggucguauacggaacaugccaccacaagaaaggcgaagcuaggcgcucccgacgcgccgucacccuaccgagccauuccaccagaaaacuccaaacgaggucccagaccuggcuggaaucccgagaauacacaaaacaccuuauacgaguagaaaacuggauauuccgaaacccgggguucgcccuggccgccgcugccauagccuggcuccucggcuccuccacaagccaaaaaguaauauaccugguaaugauccuacuaauagcccccgccuacagcaucaggugcaucggcgucucaaacagagacuucgucgaaggcauguccggcggaaccuggguggacguaguccuggagcauggcggaugcgugacaguaauggcccaagacaagccaaccguagacaucgaacugguaacuacaaccgucagcaacauggccgaaguccgaagcuacugcuacgaagccagcauaagcgacauggccuccgacucccggugcccaacacaaggcgaagccuaccuagacaaacaauccgacacgcaauacguaugcaaacgaacccuagucgacagaggauggggcaacggcugcggccucuucggcaaaggaucacucgucacgugcgccaaguucgccugcaguaagaaaaugacaggcaaaucgauacaacccgaaaaccuagaauaccgcaucaugcuaagcguacacggcagccaacacucaggaaugaucgugaacgacacaggccacgaaacagacgaaaaucgagcaaaaguagaaaucaccccuaacagcccacgugccgaagcaacacuaggaggauucggcagccuaggccuugacugugagccacgaaccggacucgacuucuccgaccuguacuaccucacgaugaauaacaaacauugguuaguccacaaagaaugguuccacgacauaccauugccauggcacgcaggcgcggauaccggaacgccacacuggaacaacaaagaagcacucgucgaguucaaagaugcacacgcaaaaagacagaccguagucguacuuggcagucaagaaggcgccguccacaccgcgcuugccggagcccuagaagccgaaauggacggcgccaaaggccgacucuccuccggacaccucaaaugccgacugaaaauggacaaacuccgacucaaaggcguaagcuacagcuugugcaccgccgccuucacauucacaaaaauaccagcagaaacucuccacggcaccguaaccguagaaguacaguacgccgggacagacggccccugcaagguaccagcacaaauggccgucgacaugcaaacccuaacacccguuggcagacuaaucacagcgaacccaguaaucaccgaaagcaccgaaaauagcaagaugaugcucgaacucgaucccccauucggcgacagcuacauagucauaggagucggcgagaagaaaaucacccaccacuggcaccgaagcggcagcaccauaggaaaagccuucgaagccacagugagaggcgcgaaaagaauggcaguccucggcgacacagcgugggacuucggcagcgucggcggcgcacucaacucacucggcaaaggcauccaccaaaucuucggcgcagccuucaaaagccucuucggcggcauguccugguucagccaaauacuaaucgggacccuacugauguggcuaggacuaaacaccaaaaacggaucgaucucccucaugugcuuagcacucggcggcguccuaauauucuuaagcaccgccguauccgcagacgugggcugcagugucgacuucucaaaa

SEQ ID NO: 2894 - RNA, 2136 nt, Artificial Sequence
  KU955593.1 prME-long CDS opt
cgaauaaucaacgcacgcaaagagaaaaagagaagaggaacagacacaucagucggcaucgucggauuacugcucacgacggcaauggcgguagaggugacccgcaggggaaacgccuacuacauguaccuagacagaagcgacgcaggagaggcuaucuccuucccgaccacaaugggcaugaacaaaugcuacauccaaaucauggaccuagggcauaugugcgacgcaaccaugagcuacgaaugcccaauguuagacgagggagucgaaccagacgacguugacuguuggugcaauaccacaagcaccugggucguauacggcacaugccaccacaagaaaggggaagcgaggcgcagucgacgcgccgucacccuacccagccauuccacacgcaaguuacaaacgcgcagccaaacguggcuagaaagccgagaauacaccaaacacuuaaucagagucgaaaacuggaucuucagaaacccgggauucgcacuagcagccgccgcgaucgccuggcuacuagguucgagcacaagccaaaaagucaucuaccuagugaugauacuccuaauagcccccgcauacagcauacgguguauaggcguaucaaacagagauuucgucgagggaauguccggcggaacauggguagacguaguacuggaacacggcggaugcguaacagucauggcacaggacaaacccacagucgacauagaacucgucaccaccaccgucagcaacauggccgaaguacgcagcuacugcuacgaggcaucaauauccgacauggcauccgacagcagaugcccaacgcagggagaggccuaccuagacaaacaauccgacacacaguacgugugcaaaagaacccuaguagaccgagguuggggcaacggcugcggacuauucgggaaaggcucgcuaguaaccugcgccaaauucgccugcagcaagaaaaugaccggcaaaucaauucaaccagaaaaccucgaauaccgaaucaugcucagcguccacggaagccaacacagcggaaugauaguaaacgacaccggccacgaaacagacgagaacagagcgaaagucgaaauaacacccaacaguccccgcgcagaagccacccugggaggauucggcagccucggccuagacugcgaaccacgaacaggacuagacuucagcgaccuguacuaccugacaaugaacaacaaacauuggcuaguacacaaagaaugguuccacgacauaccacucccuuggcacgcuggcgccgacacaggaacaccccacuggaacaacaaagaagcccuagucgaguucaaagaugcacacgcaaaacgccaaaccguagugguccugggcucacaggaaggagccgugcacacagccuuagcgggcgcgcucgaagccgaaauggacggagccaaaggcagauuaagcagcggacaccucaaaugccggcugaaaauggacaaacugcgacucaaaggaguauccuacagccucuguacagcggccuuuacauucacaaaaauaccagcggaaacgcuucacgggacaguaacaguugaaguacaauacgcuggaacagacggacccugcaaaguaccggcacagauggccgucgacaugcaaacccuaaccccaguaggacgccugauaacggccaacccagugaucaccgaaagcaccgaaaacucaaaaaugaugcucgaacucgacccgccauucggcgacagcuacauagucauaggagugggagaaaagaaaauaacgcaccacuggcaccgcagcggcaguacaaucggaaaagccuucgaagcaaccgugcgcggcgcaaaaagaauggccguacuaggagacaccgcuugggacuucggcagcguaggcggagcccucaacagccucgggaaggggauccaccaaaucuucggagcagccuucaagagccuuuucggaggcauguccugguucagccagauacuaauagggacccuacugguauggcuaggucucaacaccaaaaacggcagcauaagucuuaugugccucgcacuaggcggaguacuaauauuccuaagcacagcagugagugccgacguaggcugcagcguagacuucuccaag

SEQ ID NO: 2895 - RNA, 2136 nt, Artificial Sequence
  KY272987.1 prME-long CDS opt
cgaaucauaaacgcccgcaaagaaaagaaaaggagaggcacagacacaagcguaggaaucguggggcuccugcuaacaacagccauggcggccgaggucacccguagaggcagcgcguacuacauguaccuagaccgcagcgacgccggagaggccaucagcuucccgacaacccuaggcaugaacaaaugcuacauacaaauaauggaccucggccacaugugcgacgcgaccaugucauacgaaugcccaaugcuggacgaaggagucgaacccgacgacguagacugcuggugcaacacaacgagcacguggguagucuacggaaccugccaccacaagaaaggcgaagcacgacgaucccgacgagcggucacgcucccaagccacuccacccgaaaacuccagaccagaagccaaaccuggcuagaauccagggaauacaccaaacaccucauccgcguagaaaacuggauauuccgaaaccccggcuucgcacucgcagcagcagccauagcauggcuacucggcagcagcacaagccaaaaaguaauauaccuggugaugauacuacugaucgcccccgccuacagcauccgcugcauuggagucaguaacagagacuucguagagggcaugaguggaggaacauggguggacgucguccuggaacacggaggaugcgucacaguaauggcacaagacaaacccacagucgacaucgaacucguuacaacgaccgucucaaacauggccgaaguacgcagcuacugcuacgaggcaaguauaagcgacauggcaagcgacagccgaugcccgacccaaggagaagcauaccuggauaaacaaagcgacacgcaauacgucugcaaaagaacccuagucgaccgcggaugggggaacggaugcggacuauucggaaaagggagccucguaacaugcgcaaaauucgcgugcucaaagaaaaugacaggcaaaagcauccaaccagaaaaccuagaauaccgaaucaugcuaagcguacacggaucccaacacagcggaaugauagucaaugacacgggacaugaaacagacgaaaacagagccaaagucgaaauaacaccaaacaguccccgcgcggaagccacccucgggggauucggaagccucggcuuagacugcgagccgcgcacaggacuagacuucagcgaccuauacuacuuaaccaugaauaacaaacauuggcucguccacaaagagugguuccacgacaucccacuuccguggcacgccggcgcggacacaggcacaccgcacuggaacaacaaagaagcccucguggaguucaaagacgcccacgccaaacgacaaacagucguaguucuagggucccaagaaggcgcaguacacaccgcacucgcaggcgcccucgaggccgaaauggacggcgccaaaggccgacuguccagcggacaccucaagugcagacuaaaaauggacaagcuccgccuaaaaggcguaucauacucgcuauguacagcggcauucacauucaccaaaaucccagccgaaacccuccacggaaccguaacaguagaaguacaauacgcaggaacagacggcccgugcaaaguaccggcccaaauggcaguagacaugcaaacacucacacccgucggaaggcuaaucacagcaaacccagucauaacggaaagcacagaaaacagcaaaaugaugcucgaacuagacccaccguucggcgacagcuacauaguuauagggguaggagaaaagaaaauaacacaccauuggcauagauccggcagcacaaucgggaaagcauucgaagcgacagucagaggagcuaaacgaauggccguacucggcgacacagccugggacuucggauccgugggcggggcccugaacagucucggcaaaggaauccaccaaaucuucggagccgcauucaaaucgcuauucggcggcauguccugguucucccagauccuaaucggaacccuauuaauguggcucgggcuaaacaccaaaaacggauccauuucccugguaugccucgcccucggaggaguacucauauuccugagcacagccgucagcgccgauguaggaugcuccguggacuucagcaaa

SEQ ID NO: 2896 - RNA, 2136 nt, Artificial Sequence
  EU545988.1 prME-long CDS opt
cgcauaaucaacgcaagaaaagaaaagaaacgccgaggcacagacaccagcgugggcauagucggacuacuccuaacaaccgccauggccguugaagucacacgacgaggaagcgcauacuacauguaccuagaccguagcgacgccggagaagcaauauccuucccaaccacccuaggaaugaacaaaugcuacauccaaauaauggaccuaggccauaugugcgacgcuacgaugaguuacgaaugccccaugcuggacgaaggcguagagccggacgacgucgacugcuggugcaacaccaccagcaccuggguagucuacggaaccugccaccacaagaaaggcgaggcacgcagaagccgccgagcagucacccuaccaucccacucaacacgcaaacuacaaacaagaucccaaaccuggcuggaaagccgcgaauacacaaaacaccugauacgagucgagaacuggaucuuccgaaacccaggcuucgcccucgccgcagccgccaucgcguggcuacucggcagcuccacuagccaaaaagugauauacuuaguaaugauacuccucaucgccccagccuacucgauccgcugcaucggcgucagcaauagggauuuuguagaaggcaugagcggcgguacuugggucgacgucgugcuagagcacggcggcugcgucacaguaauggcacaagacaaacccgccgucgacaucgaacucguaacgacgacaguaucaaacauggccgaagucagaucguauugcuacgaagccuccaucagcgacauggccagcgacucccgcugcccaacacagggagaagcauacuuagacaaacaaagcgacacacaauacguaugcaaacgaacccuagucgaccgcggaugggggaacgggugcggucuauucggaaaaggaucacucguaaccugcgccaaauucgcgugcagcaagaaaaugaccggcaaaucgauacaaccagaaaaccucgaauacagaaucaugcuauccguccacggcucccaacacucuggcaugaucguaaacgauaccggccacgaaaccgacgaaaaccgagccaaaguggaaaucaccccgaacagcccucgggcagaagccacgcugggcggguucgggagccuaggacucgacugugaaccacgcaccggacuagauuucagcgaccuauacuaccugaccaugaacaacaaacacugguuaguccacaaagaaugguuccacgacauaccacucccauggcacgcaggcgccgacacaggcaccccacacuggaacaacaaagaagcacugguagaguucaaagacgcccacgccaaacgccaaacggucguagugcuagggucacaggaaggcgcgguccacaccgcccucgccggcgcccuggaagcagaaauggacggugccaaaggacgccucagcucaggacaccuaaaaugccgacucaaaauggacaaacugcgccucaaaggggucucauacucacuaugcaccgccgccuucaccuucaccaaaaucccagccgaaacacuccacggaacaguaaccguggaaguccaguacgccggcaccgacggacccugcaaggugccagcacaaauggccguagacaugcaaacccucaccccagucggacgccuaauaacugccaaccccgucaucaccgaaagcacagaaaacucaaaaaugaugcuugaacuggaucccccauuuggcgacagcuacaucgucaucgggguuggcgaaaagaaaaucacacaccacuggcaucgcucaggcuccaccaucggcaaagcguucgaagccaccguccgcggcgcaaaacgcauggccguacugggagacaccgcaugggacuuuggaagugucggaggcgcccugaacucacuagggaaaggaauacaccaaaucuucggagcagcguucaaaagccucuucggcggaaugaguugguucagccaaauccuuauaggaacccuccucguauggcucggguuaaacaccaaaaacgggagcauuagccuuacaugccuagcccucggcggcguacucauauuccucagcaccgcugucucggccgacgucggcuguuccguagacuucagcaaa

SEQ ID NO: 2897 - RNA, 2136 nt, Artificial Sequence
  KU681082.3 prME-long CDS opt
cggaucaucaacgccagaaaagaaaagaaacggcgcggagcggacacaucagucgggaucguaggccuacuucucaccacggcaauggcagucgaaguaacaagacgcggaagcgccuacuauauguaccucgaccgcuccgacgccggagaagcaaucagcuuccccacuacccuaggcaugaacaaaugcuacauccaaaucauggaccucggacacaugugugacgccacgaugucauacgaaugccccaugcucgacgaaggaguggaacccgacgacguagacugcuggugcaacaccacaucaacauggguugucuacggaaccugccaccacaagaaaggagaagcccgucgaagccggcgagccguaacacucccuucgcacucaacccgaaaacugcaaacaagaucccaaacauggcuagaaagucgugaauacacaaaacaucuaauacguguggagaacuggaucuuccgaaaccccggauucgcauuagcagccgccgucauagccuggcugcuaggaagcagcaccagccaaaaaguaauauaccuggucaugauccuacucauagcgccagccuacuccaucagauguauaggcgucucaaaccgggacuucgucgagggaauguccggaggcacuugggucgacgugguacuggaacacggcggaugcgucacagucauggcacaagacaaaccaacuguagacauagaacucgucacgaccacggucagcaacauggccgaggucagaagcuacugcuacgaagccagcauuucagacauggcaagcgacagccggugcccgacccaaggagaagcguaccuagacaagcaaagcgacacccaauacgucugcaaaagaacccucgucgaccggggcuggggcaacggcugcggacucuucggcaaaggaagucuaguaacuugcgcaaaauuugcgugcucgaagaaaaugaccggcaaaucaauccaacccgagaaccuagaguacagaauaaugcuaucaguucacggcagucagcacuccggaaugaucguaaacgacaccggccacgaaaccgacgaaaaccgcgcaaaagucgaaauaacacccaacagcccccgagccgaagccacacucggaggguucggcucccuaggacuagacugcgagccacgcaccggacucgacuucucagaccuauacuaccuaaccaugaacaacaaacacuggcucguccacaaagaaugguuccacgacauaccgcuccccuggcacgccggagcggacaccggcacaccccacuggaacaacaaagaagcccuagucgaguucaaagacgcacaugcaaaacgccaaaccguagucguacucggcagccaggaaggggccgugcacacagcccuagcaggagcccucgaagccgaaauggacggagccaaaggacgacucucaagcggccaccucaaaugccgacuaaaaauggacaaacuacgacuaaaaggcgucagcuauagccugugcaccgcagccuuuaccuuuacuaagauucccgcggaaacccuacauggcaccgucaccguagagguacaauacgccggcaccgacggcccaugcaaaguccccgcccaaauggccgucgacaugcaaacgcucacaccagucggaagacuaauaacagccaaccccgucaucaccgaaaguaccgaaaacaguaaaaugaugcuagaacucgauccacccuucggagacucauacaucgucaucggagucggcgaaaagaaaauaacacaccauuggcauaggucgggcuccacaauaggaaaagcauucgaagccaccguccgcggugcaaaacgaauggcaguccuaggggacacagcaugggacuucggcagcgucggaggugcacuaaacucccucggcaaaggcauccaccaaaucuucggcgcagccuucaaaucccuguucggaggcauguccugguucagccaaauccucaucggcacccuauuaguauggcuaggccucaacacgaaaaauggcucgauaucacuaacaugucucgcccuaggcggaguccucaucuuccuaagcaccgccguauccgcagacgucggaugcuccguagacuucucaaaa

SEQ ID NO: 2898 - RNA, 2136 nt, Artificial Sequence
  KX601167.1 prME-long CDS opt
cgaauuauaaacgcccgcaaagagaagaaaagacgcggagccgacacauccguggguaucgucggacuccuccuaaccaccgccauggccgucgaaguaacccgacgcggauccgcguacuacauguaccuugaccgcucagacgcgggggaagccauaucuuuucccaccacacuaggagucaacaaaugcuacauccaaaucauggaccuaggccacaugugcgacgccacaaugagcuacgagugccccaugcucgacgaagggguugaaccagacgacguugacugcuggugcaacaccacguccaccuggguugucuauggaaccugccaccacaagaaaggcgaagcccgccggucccgccgagccgucacccugcccagccacagcacacgcaaacuacaaacccgaucucaaacauggcuagagucacgagaauauacaaaacaccucauccgagucgaaaauuggaucuuccgcaacccaggcuucgcgcucgccgcagccgccaucgcauggcuccucggauccucaaccucacaaaaaguuauauaccugguaaugauauuacucauagcaccagccuacucaauacgaugcauaggagucuccaaccgcgacuucgucgagggcaugagcggaggcaccuggguagacgucguccuagaacacggaggcuguguuaccgucauggcgcaagacaaacccacagucgacaucgaacucguaacaaccaccgucuccaauauggcggagguacgaucauauuguuacgaagcaucaauaucagacauggcgagcgacagucgcugcccgacccaaggcgaagccuaucuugacaaacaaagcgacacacaguacguaugcaaacgaacacucguagaccgaggcuggggcaacggcuguggccuguuuggcaaagguagccugguaacaugcgcaaaauucgccugcuccaagaaaaugaccggcaaaucaauacaacccgaaaaccuagaauaccgcaucaugcuguccguccacggcagccaacacagcggcaugaucgucaacgacaccggacacgaaaccgacgaaaaccgcgccaaaguagagauaacaccuaacucaccccgagccgaagccacacucggaggcuuuggcagccuaggacucgacugcgaaccccgaacaggacucgacuucuccgaccuauauuaccuaacaaugaacaacaaacacuggcuaguacacaaagaaugguuccacgacauaccacuacccuggcacgccggagccgacaccggaacaccccacuggaacaacaaagaagcacucgucgaguucaaggacgcacacgccaaacggcagaccgucguuguccuaggcucacaagaaggcgcgguccacaccgcucucgcaggcgcccucgaagcagaaauggacggcgccaaggggaggcucuccuccggacaccucaagugccgccuaaaaauggacaaacuacggcucaaaggaguaagcuacagccucugcacagcagcauucacauucaccaaaauaccagcagaaacgcuacauggaacagucacggucgaaguacaauacgcgggcacagacggacccugcaaagugcccgcacaaauggcgguugacaugcaaacccuuacgccagucggccgacucaucaccgccaaccccgucauuacagaauccacagaaaacuccaaaaugaugcuugaacuggacccacccuucggcgacucguacauaguaauaggcgucggcgacaagaaaaucacccaccacugguaccgcuccggcucaacaaucggaaaagcauucgaagcaaccguccgaggugccaaacguauggcaguacuaggcgacaccgccugggacuucggcuccguaggaggagcacucaacucccucggaaaaggaauccaucaaauauucggagccgccuucaagucccuauucggcggcaugucaugguuuagccagauccucauaggaacccugcuaguauggcuaggccucaacaccaaaaacgggucaaucucuuuaaccugccuagcauuagggggaguucucauauuccucagcacagcaguaagcgccgacguaggcuguuccgucgauuucucaaaa

SEQ ID NO: 2899 - RNA, 2136 nt, Artificial Sequence
  KX694533.2 prME-long CDS opt
cgcauaaucaacgcacgcaaagaaaagaaaagacgcggagcagacacaagcgugggaauuguaggccugcuauuaaccacugccauggcgguagaaguaacacgacgcggaucagcauacuacauguaccuggacagaagcgacgcuggcaaagccaucuccuucccaacaacgcugggaguaaacaaaugcuacauccaaauaauggaccuagggcacaugugcgacgccacaaugagcuacgaaugcccgaugcucgacgagggaguagaaccagacgacgucgacugcuggugcaacacaacuagcacauggguaguauacggcaccugucaccacaagaaaggagaagcacgccggagccgacgggcagucacgcuacccucacacagcacacgaaaacuacaaacucgcucccaaaccuggcucgaaagccgagaauacaccaaacaccuaauccgcgucgagaacuggaucuuccgcaacccaggauucgcacuagcagcugcagcaaucgcguggcugcucggaagcagcacaagccaaaaaguaauauaccuaguaaugauacuccucaucgcccccgccuauaguauacggugcaucggcgucagcaaccgagacuucgucgaaggcaugagcggcggcacgugggucgacgucguccucgaacauggcggaugcgucacaguaauggcccaggacaaaccaaccgucgacaucgaacuugucacaacgaccgugagcaacauggccgaaguccgcuccuacugcuaugaagccuccaucucagauauggccucagacagccgaugcccaacccagggcgaggcauacuuggacaaacaaagcgacacccaauacgucugcaagcgaacacuggucgaccgagggugggguaauggaugcggccuauucggcaagggaagccuagucaccugugcaaaguucgccugcucaaagaaaaugacagggaaauccauccaacccgaaaaccucgaguaccgcauaauguugagcguccacggcucccaacacagcggcaugauaguaaacgacaucggccaugaaaccgacgaaaaucgagcaaaaguagaaauaacaccuaacaguccgagagcggaagcaacacuaggaggcuucggcucgcuaggccuagacugcgaaccccgaaccggacucgacuucagcgaccuauacuaucucacuaugaacaacaaacacuggcucgugcacaaagagugguuccacgacaucccgcuccccuggcacgcaggagccgacacaggcaccccacacuggaacaacaaagaagcgcuagucgaguucaaagacgcacacgcuaaaagacaaaccguggucguccuaggcucacaagaaggcgcaguacacacagcacuagccggcgcucucgaagcagaaauggacggagccaaaggucgacuauccuccggccaccuaaaaugccgccucaaaauggauaaacuccgccucaaaggcguaucauacagucuaugcaccgccgcauucacauucacaaaaauaccagccgaaacccuccacggcaccguaaccguagaaguacaguacgcaggaaccgacggaccaugcaaagugccagcccaaauggcagucgacaugcaaacacucacuccagucggacgacuaaucaccgcuaaccccgucauaaccgagagcacggaaaauuccaagaugaugcuagaacuggaucccccguucggcgacagcuacauagucaucggagucggagacaagaaaaucacacaccacuggcaccgaagcggcagcaccaucggaaaagcguucgaagcaaccgucagaggcgccaaacgaauggccguacucggagacacggccugggacuucggcuccgucggcggagcacucaauucccucggaaaagguauccaccaaauuuucggcgccgcauucaaaucacuauuugggggcauguccugguucucgcagauacuuaucggcacccuccuaguauggcuaggacuaaacaccaaaaacggcagcauaagccucacaugccuagcccucggagggguccuaauauuccugagcacagccguaagcgcugacgucggcugcagcgucgacuucagcaaa

SEQ ID NO: 2900 - RNA, 2136 nt, Artificial Sequence
  KY288905.1 prME-long CDS opt
agaaucaucaacgcaagaaaagaaagaaaaagaagaggcgccgacacaucaaucggcaucgucggccugcuacuaacaacagcuauggcagcagaaaucacccgacgaggcucagcguacuacauguaccucgacagaagcgacgccggaaaagcuaucagcuucgccacgacacugggagucaacaagugccacgugcagauaauggaucucggacacaugugcgacgcaaccaugaguuaugagugccccaugcuagacgaaggcguagagccagacgacguagacugcuggugcaacacaacaagcaccuggguaguauacggcacaugccaccacaagaaaggagaagcaagacgaagcaggcgcgcaguaacacuacccucacacagcacacgaaaacuccaaaccagaagccagacauggcucgagagccgugaauacacaaaacaccuaauaaaaguggaaaacuggauauuccgcaacccaggguucacccuaguagccguagcaaucgcguggcuucucgggagcagcaccucccagaaagucauauaccucguaaugauccuucucauagcuccggccuacagcauacgaugcauaggcguaagcaaccgcgacuucgucgaaggaaugucagggggaacauggguggacguaguacuagaacacggaggcugcgucacgguaauggcacaagacaaaccaaccgucgauaucgagcuagucaccaccacagucagcaacauggcggaaguacgaagcuacugcuacgaagccucaaucagcgacauggcgagcgacucucgcugcccaacacaaggcgaagcauaccucgauaaacaaagcgacacgcaguacgucugcaaacgcacccucgucgacagaggguggggcaacggguguggccuauuuggaaagggaucauuagucacaugcgcaaaauucacaugcagcaagaaaaugacagggaaaagcauccaaccugagaaccucgaauaccgcauaaugcucagcguccauggaucacaacacuccggcaugaucgucaacgacacgggacacgaaacagaugaaaaucgagcgaaaguagaggucacaccgaauagccccagagccgaagccacacuaggaggauucggaagccucggccuggacugcgaaccgcgaaccggccucgacuucagcgaccuauacuaccucaccaugaacaacaaacauuggcuaguccacaaagaaugguuccacgacaucccccuccccuggcacgcaggcgccgacacgggaaccccucacuggaacaacaaagaagcacugguugaguucaaagacgcacacgccaaaagacaaacaguaguaguauuagggagccaggaaggagccguacacacagcccucgcaggcgcccuagaagccgaaauggacggagccaaaggcagacuguucagugggcaccucaaaugcaggcuaaaaauggacaaacuacgccuaaaaggcguaagcuacagccuaugcacagccgcauucaccuucacaaagguccccgcggaaacacugcaugggacgguaacaguagaagugcaauacgcaggcacagauggacccugcaaaguaccagcacaaauggccguagacaugcaaacacuaacacccgucggaagacucaucaccgcaaacccagucaucacggaaucaacagaaaacagcaaaaugauguuagaacuggacccacccuucggcgacucauacauaguaauaggcgucggagacaagaaaaucacgcaucacuggcaccgcagcggcagcacaauuggcaaggcauucgaagcaacagucagaggagcgaaacgaauggcaguacucggcgauacagccugggacuuuggauccgugggaggcguguucaacagccucggaaaagguauccaccaaaucuucggcgcagcguucaaaucacuauucggcggcaugagcugguucagccaaauacucaucggaacacuccuaguauggcuaggacucaacaccaaaaacggcagcaucagccugacaugccuagcgcucggaggagucaugauauuccucucaaccgcagugucggccgacguagggugcagugucgacuucagcaaa

SEQ ID NO: 2901 - RNA, 2136 nt, Artificial Sequence
  KF268950.1 prME-long CDS opt
agaauaaucaacgcccgcaaagagcgcaaaagaaggggagcagacacgagcauaggcaucaucggacuccugcucaccaccgcaauggcagcagaaaucaccagaagaggaucagccuacuacauguaccuggacagaagcgacgcgggaaaagcaauauccuucgcaacgaaucuaggcgucaacaaaugccacguacagaucauggaccuaggucauaugugcgacgccaccaugucauacgaaugcccaaugcuagacgaaggcgucgaaccagacgacgucgacugcuggugcaacaccacguccaccugggugguauacggcacaugccaccacaagaaaggcgaagcccgaaggagcagacgcgcugucacccuaccaagccacaguacgcgcaagcuccaaacaagaagccagaccuggcuagaaagccgcgaauacacaaagcaccuaaucaaagucgaaaacuggaucuuccgaaacccaggauucgcccucgcagccgucgcaaucgcauggcugcuaggaagcuccaccagccaaaagguaaucuaccuggucaugauccuacugaucgcacccgccuacucgauucgaugcaucggcguaucgaaccgcgacuucgucgaagguaugagcggcggaaccugggucgacgucguacuagaacauggcggcugcguuacaguaauggcacaagauaagcccaccguagacaucgaacucgucaccacgaccguaagcaacauggcagaaguccgcucuuacugcuacgaagcaagcaucagcgacauggcaagcgacucacgauguccaacccaaggggaagcauaccucgacaagcaaagcgauacacaauacguaugcaaaaggacccucgucgaccgaggcuggggaaacggaugcggacucuucggcaaaggaagccuaguaacaugcgccaaauuuacaugcagcaagaaaaugacaggcaaaaguauccagccagaaaaccucgaauaccgcaucaugcuuagcguacacggcagccaacacucaggaaugaucgucaacgacauaggacacgaaaccgacgaaaacagggcgaaaguagaagucacacccaacuccccacgagcagaagcuacccugggcggauucgggagccugggccucgacugugaaccgagaacaggacuagacuucagcgaccucuacuaccucacaaugaacaacaaacacuggcuggugcacaaagaaugguuccaugacauaccgcucccauggcacgcaggagccgacacaggaacaccgcacuggaacaacaaagaagcccuagucgaguucaaagacgcacacgcgaaaaggcagacagucgucguccugggaucacaggaaggcgcaguacacacagcacucgccggcgcguuagaagcagagauggacggugccaaaggacgacuguuuucagggcaccucaaaugccggcuaaaaauggacaaacugcgccucaaaggaguaucauacagcuuaugcaccgccgccuuuaccuucaccaaaguccccgcagaaacccuccacggcaccguaacaguggaaguacaauacgcagggaccgacgggccaugcaagguaccugcacaaauggccgucgacaugcaaacacucacacccgucggaagacuaaucaccgccaacccaguaauaacagaaagcacagaaaacagcaaaaugaugcuagaacuagacccaccauuuggagacagcuacaucgugaucggagugggcgacaagaaaauaacccaucacuggcaccgcucaggcagcacaauaggcaaagccuucgaagcaacagucagaggagcgaaaagaauggccguacugggagacacugccugggacuucggcuccgucggcgggguauucaacagccuuggcaaaggcgugcaccagauauucggggccgcguucaaaaguuuauucgggggaaugaguugguucucccaaauacuaauaggcacacuucuaguauggcucggacuaaauacgaaaaacggaagcauuagccucacaugcuuagcccucggcggaguuaugauauuccucaguacagcagugucagccgacgugggaugcuccguagacuucagcaaa

SEQ ID NO: 2902 - RNA, 2136 nt, Artificial Sequence
  KF383121.1 prME-long CDS opt
cgcaucauaaacgcacgcaaagaaaggaaacgcagaggagcggacaccuccauaggaauaauaggccuacuacucacaaccgccauggcggccgaaaucacgcgacgaggaucugcguacuacauguaccuggaccgcagcgaugccggaaaagccaucuccuucgcaacgacgcucggagucaacaagugccauguacaaauaauggaccucggucacaugugcgacgccacgaugucauacgaaugcccgaugcucgacgaaggcguagaaccagacgacgucgauugcuggugcaacacaacgagcacaugggucguauacggcacuugccaccacaaaaagggagaagcacgccgcagccgccgagcagucacacugccaucccacagcacgcgcaaacuacaaaccaggagccaaacguggcuagaaagcagagaauacacgaaacaccugaucaaagucgaaaacuggauauuccgaaaccccggauucgcccugguagcaguagcaaucgcauggcuacuaggcuccagcacaucccaaaaggucauauaccuaguaaugauacuacucaucgcaccagccuacagcauaagaugcaucggcguaagcaaccgcgacuucgucgaaggaauguccggcgggaccuggguugacguaguacucgaacacggcggaugcgucaccgugauggcacaagacaaacccacgguagacaucgaacucgucacaacgacagucagcaacauggcggaagugcguucguacugcuacgaagccagcauaucagacauggcauccgacucaagaugcccaacacaaggcgaagccuacuuagacaaacaaucagacacccaauacgucugcaaacggacacuugucgaccgcggauggggaaacggaugcggacuauucggaaaaggcucgcuagugacaugcgcaaaguucacaugcucaaagaaaaugacaggcaaauccauacaaccagaaaaccuugaauaucgaauuaugcucagcguccacggcucccaacacucaggaaugauagucaacgacauaggacacgaaacagacgaaaacagagccaaaguggaggucacaccaaacucccccagagcagaagcaacacuaggaggauucggaucccugggacuagacugcgaacccaggacaggccuugacuucuccgaccucuacuaccucaccaugaacaacaaacacuggcucguccacaaagaaugguuccacgacauaccccugcccuggcaugccggggcagacacagggacaccccacuggaacaacaaagaggcucugguagaguucaaagacgcgcacgcgaaaagacaaacagucgucguccucggcucccaggaaggcgccguacauacagcacucgcuggcgcgcuagaagccgaaauggacggcgcaaaaggcagacucuucuccggacaccuaaaaugccgacucaaaauggacaaacuacgacugaaaggcguauccuacagccuauguacagcagcauucaccuucacuaaaguaccagccgaaacccuacacggcacaguaaccguagaaguccaguacgcaggaacagacggccccugcaaaguaccagcacagauggcagucgacaugcaaacgcugaccccgguagggaggcucauaaccgccaacccaguuaucacggaaucaaccgaaaacagcaaaaugaugcucgaacuggacccacccuucggcgauucauacauaguaauaggaguaggcgacaagaaaauaacccaccacuggcacagauccggcagcaccauaggcaaagccuucgaggccacaguacgcggcgccaaaagaauggccguacucggagacaccgcaugggacuucggauccgucggaggcguauucaacagccucggcaaaggaauccaccaaauauucggagccgccuucaaaagccuauucggaggcaugagcugguucagccaaauccuaaucgggacgcuccuaguauggcuaggccucaacaccaaaaacggaagcaucagccuaaccugucuagcccugggcggcguaaugaucuuccuaagcaccgcggucagcgccgacguaggcugcagcguugacuuuucaaaa

SEQ ID NO: 2903 - RNA, 2118 nt, Artificial Sequence
  KF268949.1 prME-long CDS opt
agaauaaucaacgcaaggaaggaaaggaaaaggaggggcgcagacacgagcauagggauaaucggccuacuacugacaacagcgauggccgccgaaauaaccaggaggggcagugcauacuacauguaccuggacagaagcgacgccgggaaagcgaucucguucgcgacuaaccucggcgucaacaagugccacgugcaaauaauggaccucggccacaugugcgacgcaaccaugucguacgaaugcccgaugcuagacgaaggaguggaacccgacgacguagacugcuggugcaacacaacgagcaccuggguaguauacggaaccugccaccacaagaaaggcgaagcgcgccggagccggcgagcggucacacucccaagccauagcacacgaaaacuccagacccgcagccagacauggcuagaaagcagagaauacacaaagcaccugaucaaagucgaaaacuggauauucagaaacccaggguucgcacuagcagcgguagccaucgccuggcugcuaggcagcuccacuagccagaaggucauauaccucguaaugaucuuacucaucgcgccagcauacucaauaaggugcaucggcgugagcaaccgcgacuucgucgaaggcaugucgggaggaaccugggucgacgucguccuagaacacggcggcugcgucacaguuauggcacaggacaagcccacaguagacauagaacucgucacaacaaccgugagcaacauggccgaaguacgaagcuacugcuaugaagcgucaaucucagacauggcaucagacagccgaugccccacacagggggaagcauaccucgacaagcaaagcgacacccaauacguauguaaacgaacccucgucgacagaggaugggggaacggauguggccuauucggaaaaggcagccucgugaccugcgcaaaauuuaccugcucaaagaaaaugacgggaaagagcauccaacccgaaaacuuagaauacagaaucaugcuauccguccauggaucccaacacagcggcaugauagucaacgacgaaaacagagccaaaguggaggucacgccaaacagcccaagagccgaagccacccucggcggauucggcagcuugggccuagauugcgaacccaggaccggacuagacuucuccgaucuuuauuaccugaccaugaacaacaaacacuggcuaguacacaaagaaugguuccacgacaucccacuaccauggcacgcaggagcagacacagggaccccgcacuggaauaauaaagaagccuuggucgaguucaaagacgcacacgcgaaacgccaaaccguaguaguacuaggcucccaagaaggugcgguccacaccgcucuagccggagcccucgaagcagaaauggacggcgccaaaggccgacuguucucaggccaccuaaaaugucgacuaaaaauggacaaauuacgccucaaaggcguaaguuacucgcucugcacagcggcauucaccuucaccaaagugccagccgaaacuuuacacggaaccguaaccgucgaaguacaauaugcgggaacagacggacccugcaaaguuccagcucaaauggcggucgacaugcagacgcucacccccgucggccgacucauaaccgccaaccccgucauaacugaaagcacagaaaacucaaagaugauguuagaauuagacccacccuucggcgacucauacaucguaauaggcguaggagacaagaaaauaacccaccacuggcaccgaucagguagcacgauagguaaagcauucgaagccacagucagaggcgcaaaacgcauggcagugcugggcgacacagcgugggacuucggauccgucggcggaguauucaacucacucgggaaagggauccaccaaauauucggagccgcauucaaaucccuauucggcggaaugagcugguucucccaaauacuaauaggcaccuuauugguauggcuagggcucaacaccaaaaacggaagcauaagccugaccugccuagcacucggaggagucaugauauuccucagcaccgcagucagcgcagacgucggaugcagcguggacuuuagcaag

SEQ ID NO: 2904 - RNA, 2136 nt, Artificial Sequence
  KU955595.1 prME-long CDS opt
agaauuaucaacgcccgaaaagaacgcaagcggcgaggcgcagacaccucaauaggaaucgucggccuacuacuuaccacagcgauggcggcagaaaucacacgacgcggcagugcauacuauauguaccuagaccgcucagacgccggcaaagcaaucaguuucgcaaccacccucggcgucaacaagugccacguccaaauuauggaccuaggccacaugugcgacgccaccauguccuacgaaugccccaugcuugacgaaggagucgaacccgacgacgucgacuguuggugcaacaccacaagcaccugggucgucuacggcacaugucaccacaagaaaggcgaagcgcgaaggagcagacgagcgguaacccuaccaucccauuccacccguaaacuucaaacacgcagccaaaccuggcucgaaagccgagaauacacaaaacaccuaaucaaagucgaaaauuggauauuccgcaacccgggguucgcucuagucgccguggccauagccuggcuccuaggcuccucaacgucacaaaagguaauauaccucgucaugauacuccuaaucgcaccagcguacagcauccgaugcauaggcgucagcaaccgcgacuucguggaggggaugagcggaggcaccuggguagaugucguacucgaacauggaggcugcgucacagucauggcacaagacaagccaacaguggacauagaacucgucacaacgacgguuagcaacauggccgagguacgaagcuacugcuacgaggccagcauaucagacauggccagcgacucaaggugccccacccaaggggaagcauacuuggacaaacaauccgacacccaauacgucugcaaacggacccugguggaccgaggguggggcaacggcugcggccucuucggaaaagguucccucguuacaugcgccaaauuuacgugcagcaagaaaaugaccggaaaaucaauacaaccugaaaaccucgaauacagaauaaugcucagcguccacggcucgcaacacagcggaaugaucguaaacgacaccggacacgaaaccgacgaaaaccgcgccaaagucgaagucacaccaaacuccccacgcgccgaagccacacucggcggauucgguagccuaggacuggacugcgaaccacgcacaggacuagacuucuccgaccucuacuaccuaaccaugaacaacaaacacuggcucguccacaaagaaugguuccacgacauaccccucccauggcaugcgggcgccgacaccggcacaccccacuggaacaacaaagaagcucuaguagaguucaaagacgcacacgcuaaacgccaaaccgucguaguccuuggcucccaagaaggcgcuguacauaccgcccuagcuggugcccucgaagcagaaauggacggagccaaaggacgccuguucuccggccaccucaaaugccgccucaaaauggacaaacuccgccucaaaggaguaucauacucccuaugcaccgcagcuuucacguucacaaaagugccagccgaaacacuacacggaacagugaccgucgaaguccaauacgccggcaccgacggacccugcaaaguacccgcccagauggccguagacaugcagacccuuacccccgucggaagacuaaucaccgcaaacccagucaucaccgaaucaacagaaaauagcaaaaugaugcucgaauuagacccacccuucggcgacucauacaucgucauuggcguaggcgacaagaaaauaacccaccacuggcacaggucagguuccaccaucggcaaagcauucgaagccaccguacgaggcgccaaacgcauggcaguccuaggagacaccgcgugggacuucggcagcgugggaggaguuuucaacucccucggaaaaggaauccaccaaaucuuuggcgcggcauuuaaaagucuauuuggaggaaugagcugguucucacaaauucugauaggcacccuccucgucuggcuaggucuaaacaccaaaaacggcaguaucucacuaaccugccucgcacuaggagggguaaugaucuuccucaguaccgcagucuccgcagacguugggugcagcgucgacuucuccaaa

SEQ ID NO: 2905 - RNA, 2136 nt, Artificial Sequence
  KF383116.1 prME-long CDS opt
cgaauaaucaacgcgaggaaagaacgaaagagacggggcgcggacacauccauaggcauaguagggcugcugcuaacaacggcgauggcagccgaaauaacaagaaggggaagcgccuacuacauguaucucgaccgaucggacgccgggaaagcaaucagcuucgcaaccacccucggaguuaacaaaugccacguacaaaucauggaccuaggccacaugugcgacgccacaaugagcuacgaaugcccaaugcuggacgaaggcguggaacccgacgacgucgacugcuggugcaacacgacaagcaccuggguggucuacggcacaugccagcacaagaagggggaagcccgacgauccagacgcgcggucacacugccaagccacuccacccgcaaacuacagacaaggagccaaaccuggcucgaaagccgagaauacaccaaacaucucauaaaaguagagaacuggauauuccgaaacccuggguucgcccucgucgcgguggcaaucgcauggcuacuaggauccagcacgagccaaaaagucauauaccuaguaaugauacucuuaaucgcgccagcauacucaauccgaugcauaggcgucuccaacagagauuucgucgaaggaauguccggcggcaccuggguagacgucgugcuagaacauggaggcugcguaacaguaauggcacaagacaaaccaacagucgacaucgagcucgugacaacaaccguaaguaacauggcggaagugcgcucguacuguuacgaagccagcaucucugacauggcaagcgauagcagaugcccaacgcaaggcgaagcguaccucgacaagcaauccgacacacaguauguaugcaagaggacauugguagacagagguugggguaacggaugcggacuguucggaaaaggcucgcuaguaaccugcgccaaauucacaugcaguaagaaaaugacaggcaaaagcauacagcccgagaaccucgaauacaggauaaugcucucagugcacggaagccaacacagcggaaugauaguaaacgacauuggccacgaaacugacgagaacagagcaaaaguagaagugacacccaacagcccaagggcggaggcaacacuaggcggauucggcagccuaggccuagacugugaaccgcgaacaggccucgacuucagcgaccuauacuacuuaaccaugaacaacaaacacugguuggugcauaaagagugguuccacgacauaccacuuccauggcacgccggagcagacacagggaccccacacuggaacaacaaagaagcacuggucgaguucaaagacgcgcacgccaaacgacagacaguagucguccugggaagucaagaaggcgcgguacacaccgcacucgcaggcgcccuagaagccgaaauggacggcgccaaaggaaggcuguucaguggccaccuaaaaugcaggcucaaaauggacaaacuucgacugaaagggguaagcuacucguugugcaccgccguaugcacagccgccaaaguacccgcggaaacacuacacggcacggugacaguggaaguccaguaugccgggaccgacggacccugcaaggucccagcccaaauggcaguagauaugcaaacccucacgcccguagggcgacuaauaaccgcaaacccaguaauaacagaaucgacagaaaacagcaaaaugaugcuggaacucgacccgcccuucggagacagcuauauaguaauaggggucggagacaagaaaauaacacaccacuggcaccggagcggaagcacaauugggaaagcauucgaagcgacagugcggggagcuaaaaggauggcgguacuaggagacaccgcaugggauuucgggagcgucggcgggguauucaacagccuagggaaaggcauacaucaaauauuuggcgcagcuuucaagagccuauucgggggcaugagcugguucucacaaauacuaauaggaacccuccuagucuggcucgggcucaacacaaagaauggaucaauaagccuaacaugccuugcucucggaggcgugaugauauuccuaucaacagcggugagcgcggacgugggaugcuccguagacuucagcaaa

SEQ ID NO: 2906 - RNA, 2118 nt, Artificial Sequence
  KU963574.2 prME-long CDS opt
cgaauaauaaacgcccgcaaggaaagaaaacgcaggggcgccgacgccucaauaggaaucgucucacuccuacucacaacagugauggccgcagagaucacgcgcagaggauccgcauacuacauguaccuagacagaagcgacgcaggaaaggcaauauccuucgucacaacccucggcgugaacaaaugccacguccaaauaauggaccuaggccacaugugcgacgccacaaugucauacgagugcccaaugcuggacgaaggcgucgaaccggacgacgucgacugcuggugcaacacaacguccacauggguagucuacggaaccugccaccacaagaaaggcgaagcacggaggagccggcgcgcaguaacauuaccaucacacaguacccgaaaacuccaaaccagaucccaaaccuggcuagagagccgcgaauacaccaaacaccuaaucaaaguggaaaacuggauauucagaaaucccggauucgcacucgucgccguagccaucgcauggcuacugggauccagcacaagccaaaaaguuaucuaccucguaaugauacuccugaucgcacccgcauacucaauaagaugcauaggcguaagcaaccgcgacuuuguagaaggaaugagcggagggacgugggucgacgucguacuagagcacggaggaugcgucaccgugauggcccaggacaaacccaccgucgacauugaacucgucacgaccacaguaagcaacauggccgaaguacggucauacugcuacgaagccucaauaagcgacauggcaucagacucacgcugcccaacacaaggggaagccuaccuagauaagcaauccgacacccaauacguaugcaaacgcacccuagucgaccgcggaugggggaacggaugcggacuauucggcaaaggaucgcuggugaccugcgccaaauucacaugcucaaagaaaaugaccgggaaaagcauccaaccagaaaaccucgaauaccguauaaugcuaucaguccacggcucucaacauucaggcaugaucgucaacgacgagaaccgcgcaaaaguagaggugacccccaacuccccaagagcagaggcgacccucggaggauucggcucacugggccuagacugcgaaccccgcaccggcuuagacuucagcgaccucuacuaccuaaccaugaacaacaaacacuggcuaguacacaaagaaugguuccacgacauaccacuucccuggcauucaggggccgauaccgaaaccccgcacuggaacaauaaagaagcccucguagaguucaaggacgcgcacgccaagagacagacagucguaguccuuggaagccaggaaggcgccguacacacugcccucgccggagcauuagaagccgaaauggacggcgcgaaaggccgacuaucaucuggccaccugaaaugccggcucaagauggacaagcugcgucucaagggagugucauacucacucugcacagccgcauucacauucaccaagguccccgcugaaacccuccacggaaccgugaccgucgaaguccaauacgccggacgagacggaccuugcaagguucccgcccagauggccgucgacaugcaaacccuaacacccgucggcagacuaaucaccgccaaccccgucaucacagaaucaacagaaaacucaaagaugaugcuagaacuagacccaccauucggggacagcuacauaguaauaggcgucggagacaagaaaaucacgcaccacuggcaccgcagugggucaauaauaggcaaagcguucgaagccacgguccgcggagccaaacgcauggcaguacuaggcgacaccgccugggacuucggaagcgucggaggcguguucaacucacucggcaaaggaauacaucaaauauucggcgcugccuucaaaucucuauucggagguauguccugguucucacaaauacuaaucggaacccuccucgucuggcucggacuuaacaccaaaaacgggagcaucucacugaccugccucgcccucggcggcguaaugaucuuccuaagcacagcaguauccgcagacgucggcugcagcguagacuucuccaag

SEQ ID NO: 2907 - RNA, 2118 nt, Artificial Sequence
  KX601166.1 prME-long CDS opt
cgcaucauaaacgcccgcaaagaaagaaaaagaagaggagccgacaccaguaucggaauaguuggacuccuccuaacaaccgccauggccgccgaaauaacccgccgcggcagcgcuuacuacauguaccucgacaggagcgaugcaggcaaagccaucucauucgccacaacuuugggcguaaacaaaugccacgugcaaaucauggaccucggccacaugugcgacgccacuauguccuacgaaugccccaugcucgacgaaggcguagaaccugacgacguagacugcuggugcaauacaaccagcaccuggguagucuauggaacaugccaccacaagaaaggugaagcacgccgaucacggagagccguaacccuacccucucacagcacccgcaaacuacaaacccgcucccaaacauggcuagagucacgcgaguacaccaaacacuuaaucaaaguggaaaacuggaucuuccguaaccccggcuucgcccucgucgcagucgccauagccuggcuccucggcucauccacaucccaaaaagucauauaccuaguaaugauacuccuuauugcaccagccuacagcaucagaugcaucggcgucucaaaccgagauuucgucgagggcaugucuggaggaaccugggucgacguaguccucgaacacggaggcugcgucaccguaauggcccaagacaaaccaacaguugacauagagcuagugaccaccacagugagcaauauggccgaaguucgauccuacugcuacgaagccagcaucucagacauggccagugacucucgcugccccacccaaggagaggccuacuuagacaaacaaagcgacacacaauacgucugcaagcgcacccucgucgaccgcggauggggaaacgguugcggauuauucggcaaaggcucucucguuaccugcgcgaaauucaccuguuccaagaaaaugaccggcaaaagcauccaacccgaaaaccuagaauacaggauaaugcucagcguccacggcucgcaacacuccggaaugaucgucaacgaugaaaaccgggccaaagucgaagucacgccgaacucaccaagagcugaagcuacacuaggcggcuucggaagccucggccuggacugcgaaccccgcacaggccucgacuucucagaccucuacuaccucaccaugaacaacaaacacuggcucguacacaaagaaugguuccacgacauaccccucccauggcacgcaggcgcagacacaggcacaccccacuggaacaacaaagaagcacucguggaguucaaagacgcccacgcaaaacggcaaacagucgucguacuaggcagccaagaaggcgcuguccacaccgcacuugcaggcgcccucgaagccgaaauggacggagcuaaaggcagacucuucagcggccaccuaaaaugccgccucaagauggacaaacugcgacuuaaaggcgucucguacucccuaugcacagcagccuucaccuucacaaaggucccggcggaaacacuacacgggaccguaaccgucgaaguacaauacgcaggaaccgacggccccugcaaaguacccgcacaaauggcggucgacaugcaaacacugacccccgucggacgccugauaaccgccaaccccgucauaaccgagucaacagaaaacagcaaaaugaugcucgaacuagacccucccuucggcgauucuuacaucgucauaggagucggcgacaagaaaaucacacaccacuggcacagauccgguucaacaaucggcaaagcauucgaggccaccguccgcggcgccaaacgcauggcagucuuaggcgacaccgccugggacuucggcagcguaggcggaguauucaacagucucggcaaaggcauccaccaaauauuuggcgccgcguucaaaagccuguucgggggcauguccugguucucccaaauccucauaggaacccuccuaguauggcuuggacuaaacaccaaaaacggcuccauaucccuaaccugccucgcucucggcggggugaugauauuccucagcacagcaguguccgccgacgucggcugcuccguugacuucuccaag

SEQ ID NO: 2908 - RNA, 2136 nt, Artificial Sequence
  KF383118.1 prME-long CDS opt
cgaaucauaaacgcaagaaaagaaagaaaaaggagaggcgccgacaccucaaucgguauaaucggccuacuccucacaacggccauggccgcagaaaucacaagacgaggcuccgcauacuacauguaccucgaccguucagacgcgggcaaagcaauaucauucgccacaacccucggaguaaacaaaugccacguccaaauaauggaccuaggacacaugugcgacgccacuaugagcuacgaaugcccaaugcuagacgaaggagucgaacccgacgacgucgacugcuggugcaacaccaccucgaccuggguaguguacgggaccugccaccacaaaaagggggaaacccgaagaucccggaggagugugagccuaagguaccacuacacacgaaaacuccagaccagaagccaaaccuggcuggaauccagagaauacaagaaacaccucauaaugguagaaaacuggauauucagaaacccaggauucgcgauagucagcguggcaaucacauggcuaaugggaagccucaccucccaaaaaguaauauacuuagugaugaucguccucauaguaccagccuacagcaucagcugcaucggagucagcaaccgcgacuuagucgaggggaugucgggcgggacaugggucgacguaguacucgaacauggaggcugcguaacagaaauggcacaagacaaacccaccguagacaucgagcucguaaccaugacagucucaaacauggccgagguccggucguacugcuacgaggcgucccugucagauauggcaagcgccuccagaugcccuacccaaggcgaaccaagucucgacaaacaaucagacacccaaagcguaugcaaaagaacacucggagacagggguuggggaaauggcuguggaauauucggaaagggaagccuaguaacaugcaguaaguuuaccugcugcaagaagaugccaggaaaaucaauacaaccagaaaaccuggaauaccgaauaaugcuccccguacacgguucacagcacagcggcaugaucguaaacgacauuggacacgaaacagaugaaaacagggccaaaguggaagugacaccgaacagcccacgcgcagaagccacccucggaggcuucggcucacucggacuggacugcgaaccacguacggggcuugacuucagcgaccucuacuaccugacgaugaacaacaaacacuggcuaguacacaaagagugguuccaugacauaccccuacccuggcacgccggcgcagauacaggcacgccucacuggaacaacaaggaggcacucgucgaguucaaagacgcccacgcaaaaaggcaaaccguagucgugcucggcucccaggaaggagcaguacauacagcacuggccggagcccuagaagcagaaauggacggagccaaaggacgccucuucucaggccaccugaaaugcaggcucaaaauggacaaacugagacucaagggcguaagcuacagccucugcacagcagccuucacauucaccaaagugcccgcagaaacacuccacggaacggucaccgucgaaguacaauccgccggaacagacggccccugcaaaguacccgcacaaauggcugucgacaugcaaacauuaacacccgucggacgacugaucaccgcaaauccgguaaucaccgaauccacagaaaauagcaaaaugaugcucgaacucgacccacccuucggagacagcuacauagucaucggcgucggugacaaaaagaucacccaccacuggcacaggagcggcagcacaauaggaaaagccuucgaagcaaccgugcgaggagcgaaaagaauggcaguguuaggcgacaccgccugggacuucggcucaguaggaggaguguucaacagccuaggaaaaggaauacaccaaaucuucggcgcggcauucaaaagucuuuucggaggaaugagcugguucagccagauauuaauaggcacccuccucguauggcuaggucuaaacaccaaaaacggcuccaucucacuaaccugccucgcgcuaggcggagucaugaucuuccucagcacagccgucuccgcagacguagggugcucagucgacuucagcaaa

SEQ ID NO: 2909 - RNA, 2130 nt, Artificial Sequence
  KF383120.1 prME-long CDS opt
cgcauaauaaacgcccgaaaagaacgcaaacgaagaggcgccgacacaucaauaggaauaauaggccuccucuuaacgacagcgauggcagccgaaauaaccaggagggguucagccuauuacauguaccuggaccgcagcgacgcaggaaaagccaucucguucgcaacaaccaugggagucaacaagugccacguacaaaucauggaccuaggacacaugugcgacgccacaauguccuacgaaugcccuaugcuagacgaaggcguagaacccgacgacgucgacugcuggugcaacaccaccagcacaugggugguauacggaaccugccaccacaagaaaggagaagcgagaccguccagacgagcgguaacacugccgagccacuccacccgcaaacuucaaaccaggucacaaacauggcucgaaagcagagaauauacaaagcaccuaaucaaagucgaaaacuggauccuccgcaacccaggauucacaguggcagcacuagcaauggccuggcuacugggaaacagcaccucacaaagagucaucuaccuagucaugauccuacuaaucgcccccgccuacucgaucaggugcaucggcguuagcaaccgggacuucguagaaggcaugagcggcggaacaugggucgacguagugcucgaacacggcgggugcgucacaguaauggcacaagacaaacccacagucgauaucgagcuagucaccacaacaguaagcaacauggccgaagucaggucguacugcuacgaagcaagcauaagcgacauggcaagugacagcagaugccccacccaaggggaagccuaccuagacaaacaauccgacacccaauacgucugcaagcgcacccuagucgacagaggguggggaaacggcugcggccuauucggcaaaggaucccuaguaacaugcgcaaaauuuaccugcagcaaaaagaugacaggcaaaucaauccaacccgaaaaccucgaauacagaaucaugcucucaguccacgguucacaacacucggggaugaucgucaacgauaucggacacgaaaccgaugaaaacagagcaaaggucgaagucacuccaaacuccccuagagccgaagcaacccucggaggauucggcucccucggccuagacugcgaaccacgcaccgggcucgacuucagcgaccuauacuaccuaacaaugaacaacaaacacuggcugguacacaaagaaugguuccacgacauaccacuaccuuggcacgcaggggccgacaccggcacaccccacuggaacaacaaagaagcgcuaguagaguucaaggacgcacacgcaaaaagacaaaccgucguaguacuaggaagccaggaaggcgcgguccacaccgcgcuggccggcgcacuagaagccgaaauggauggagcaaaagggcgccucuucuccggccaccucaaaugccggaucaaaauggacaaguuaagacuaaaaggcgucucauacagccuuugcacagcagccuucacauucucgaaagugccggcagagacacugcacggcaccguaaccgucgaaguacaauaugcaggcagagacggcccaugcaagguacccgcacaaauggcagucgacaugcagacacuaaccccagucggccgccuaauaacagcaaaccccaucaucacagaaagcacagaaaacucccgcaugaugcucgaacuagacccacccuucggcgacagcuacauaguaaucggggucggcgacaagaaaauaacacaccacuggcaccgaagugggagcacaaucggaaaagcauucgaagccacagucagaggagccaaacggauggcaguccucggcgacaccgcaugggacuucggaagcgucggaggcgucuucaacucauugggcaaaggaguccaccaaguuuuuggggccgcauucaaaagccuguucggagggaugagcugguucucgcaaauacuaaucggcacccugcucgucuggcucggccucaacacaaagaacggaucuaucucacuugcaugccucgcacucggcggcgccaugaucuuccuauccacggcagucagcgccgacguaggcuguagcguagacuuc

SEQ ID NO: 2910 - RNA, 2061 nt, Artificial Sequence
  KU321639.1 prME-short CDS opt
acaucaguaggaauaguaggccugcuacucaccaccgcaauggccgcggaagucaccagaagagggagcgcauacuacauguaccuagacaggaacgacgcgggagaggccauaucauucccaacuacgcuagguaugaacaaaugcuauauccaaauaauggaccuagggcauaugugcgacgccacgaugaguuacgagugccccaugcuagacgaaggggucgaaccggacgacguagacugcuggugcaacacaaccucaaccuggguagucuacgggaccugccaccacaagaaaggcgaagcacgccgaucaagacgagcgguaacccucccaagccacucgacaagaaaacuccaaacccgaagucaaaccuggcucgaaucucgcgaauacaccaaacaccucauucgaguagaaaacuggaucuuccggaacccaggcuucgcguuagccgccgccgccauagcauggcuacuuggaagcuccaccucccaaaaagucauauaccuaguaaugauccuccucauagcgccagccuacuccauuagaugcauaggcguaagcaauagagacuucgucgaaggcaugagcgggggcacguggguugacaucguccuggagcacggcggcugcguaacaguaauggcccaagacaaaccaaccguugacaucgagcuagugacgacaaccguaucaaacauggcagaaguaagguccuacugcuacgaagcaagcaucuccgacauggcaucagacagcagaugcccgacacaaggagaagcauaccuagacaagcaaagcgacacccaguacguaugcaaaagaacgcuggucgaccgcggauggggaaacggaugcggccuauuuggcaaaggaagccuaguaaccugcgccaaauucgcaugcuccaaaaagaugacaggcaaauccauccaaccagaaaaccuagaauaucgaaucauguuaagcguacacggaagucaacacucaggcaugaucgucaacgacacaggacacgagacagacgaaaacagagcaaaagucgaaaucacaccaaauucaccccgagcagaagccacccuagggggcuucggaucgcucggccuagacugugaaccacgcaccggacuggauuucagcgaccuauacuaccuaaccaugaauaacaagcacuggcucguacacaaagaaugguuccacgacauaccacucccauggcacgccggcgccgacacagggacgccacauuggaacaacaaagaagcacucguagaauuuaaagacgcccacgccaaacgacaaacagucguggucuuggggucccaagaaggcgcgguccacacagcacucgccggcgcccuggaagcggaaauggacggcgccaagggcagacugucaucgggccaccuaaaaugccgacuaaagauggacaaacuccgccucaaaggcguaucauacucccucugcacggcagcauucacauucaccaaaauacccgcggaaacacuacacggcaccgucacaguagaaguccaauacgccggaacggacgggccguguaagguccccgcccaaauggccgucgauaugcaaacccugacuccagucggccgacuaaucacagcaaaccccgucauaacugaauccacagagaacaguaagaugaugcucgagcucgacccacccuucggcgacagcuacauaguaaucggagucggcgagaagaaaauaacacaccacuggcaccgcagcggauccaccauaggcaaagccuucgaagccaccguccgaggugccaaacgcauggcaguacugggcgacacagccugggacuucggcagcgucggaggagcccuaaacagccugggaaaaggcauacaccaaaucuucggagccgccuucaaaucccuuuucggaggcauguccugguucagccaaauccugaucggcacccugcuuauguggcuaggccuaaacaccaaaaacggauccaucagccuaaugugccuggcccuaggcggugugcuaaucuuccuaagcacugccguaucagcu

SEQ ID NO: 2911 - RNA, 2061 nt, Artificial Sequence
  KU312312.1 prME-short CDS opt
acuucagucggcaucguaggccuacuccucaccaccgccauggcagccgaaguaacccgccgcggcuccgcauacuacauguaccucgacaggaacgacgcuggcgaagccaucuccuuccccacaacccucggaaugaauaaaugcuacauccaaaucauggaccucgggcacacaugcgacgcaacuauguccuaugaaugccccaugcuagacgaaggcgucgaacccgaugacgucgauugcuggugcaacacaaccucaaccuggguagucuacggaaccugccaccauaagaaaggcgaagcccgcagaucccgacgcgccguaacacuaccgucccacuccacgcgcaaacuccagacaaggagccagacauggcuagaaagccgcgaauacaccaaacaccuaauaagaguagagaacuggaucuuccgaaacccaggauucgcacucgcagcagcagccaucgcauggcuacucggauccagcaccucccaaaaaguaauuuaccuggucaugauccugcuaauagcgcccgcauacagcaucaggugcauaggggucuccaauagagacuucguagaaggcaugagcggcggaacguggguagacgucguacucgaacacggcggcugcgucacuguaauggcccaagacaaaccuacgguugacaucgaacucguaacaacaaccgucucaaacauggccgaaguacgauccuacugcuacgaagccucaauauccgacauggccuccgacagccggugccccacgcaaggcgaagcauacuuagacaaacaaagcgacacacaauacgucugcaaacgaacacuggucgaccgcggcuggggaaacggcuguggacuauucggaaaaggcucacucguaacaugcgcaaaauucgccuguagcaagaaaaugacaggaaaaagcauccaacccgaaaaccucgaauaccgaaucaugcugucaguccacggaagccaacauucaggaaugaucgucaacgacacaggacacgaaacugacgaaaacagagccaaggucgagauaacaccaaacagcccacgugcagaagccacccuaggaggguucgggucacucggccuugacugcgaaccgcggacgggacuagacuucagcgaccuuuacuaccucacaaugaacaacaaacacuggcuaguucauaaagaaugguuccacgauaucccacugcccuggcacgcaggcgccgacacaggcacaccacacuggaacaacaaggaagcccucgucgaguucaaagacgcccacgcgaaaagacaaaccgucgucguacuaggcucacaagagggcgccguccacaccgcccuagccggcgcccuagaggcagaaauggacggcgcaaagggccgccucucauccgggcaccucaaaugccgccucaaaauggacaaacuccgucuuaaaggcgucucguauucccuaugcaccgccgccuucacguucaccaaaauaccggcagaaacgcuccacggaaccgucaccguagaaguacaguaugccggcacggacggccccugcaaagucccagcccaaauggccgucgacaugcagacacucaccccagucggcaggcuaaucacggcgaaucccgucaucacagaauccacagaaaacucaaaaaugaugcuagaacuagacccgccauucggcgacaguuacaucgucaucggagucggcgaaaagaagaucacacaucacuggcacagaagcggcagcacaauagggaaggccuuugaagcaaccgucagaggugccaaaagaauggcaguccucggcgacaccgccugggacuucggaucgguaggcggugcccucaacucccuaggaaagggcauccaccaaaucuucggugccgcauucaaaucccuauucgggggcaugucaugguucucacagauacuaauaggaacccuccucauguggcuaggccuaaacgccaaaaacggcagcauaagccugaugugccuagcccucggcggcguacuaaucuuccucagcacagccgucucagca

SEQ ID NO: 2912 - RNA, 2049 nt, Artificial Sequence
  AY632535.2 prME-short CDS opt
acgagcauaggcauaauaggacucuugcucacaaccgcaauggccgccgaaaucacgcgacgaggcucagccuacuacauguaccuagacagaagcgacgcaggcaaagccaucucguucgcaaccacacucggaguaaacaaaugccacguacaaauaauggaucucggacacaugugcgaugcaacaauguccuacgagugccccauguuagacgaaggaguagaaccggacgacgucgacugcuggugcaauaccacaagcacguggguaguauauggcacgugccaccacaagaaaggcgaagcacgcagaagccggcgcgccgucacgcuacccagccauagcaccagaaagcuccagacacggucccaaaccuggcucgagagccgcgaauauacaaaacaccugaucaaggucgaaaacuggaucuuccggaauccuggauucgcacucgucgccguugcaaucgcuuggcuccuaggcucgagcacgagccaaaaaguaaucuaccucguaaugauacuacuaaucgcgcccgcauauucuauccgaugcauaggcgugagcaaccgugacuucgucgaaggaaugucgggcgggacaugggucgauguaguacuagagcacgggggaugcgucacggucauggcacaagacaagcccaccgucgauaucgagcucgucacgaccacagugagcaacauggcugaagugcgcucauacugcuacgaagccuccauaucagacauggcauccgacagcagaugcccuacacaaggugaagcauaccuggacaaacaaucagacacacaauacgucugcaaaaggacccuagucgaucgcggaugggggaacgggugcggacuauucggcaaaggaagccuagugaccugcgcuaaauuuaccugcucgaagaaaaugacaggaaagagcauccaacccgaaaaccucgaauacagaaucaugcucucaguccacggcucucaacauagcgggaugauaggcuacgaaacugacgaggacagagccaaagucgaggucacgcccaacagcccgcgcgcagaagcuacacugggaggauucggcagccuaggacuagacugcgaaccacgcacaggacucgacuucagcgaccuauacuaccugacaaugaacaacaaacacuggcuaguccacaaagaaugguuccacgauauaccgcucccguggcacgccggcgccgacaccgguaccccacacuggaacaacaaagaagcacucgucgaguucaaagacgcacacgcaaaaagacaaacggucguaguauuaggcucgcaagaaggcgcaguccacacagcccuagcaggcgcgcuagaagcagaaauggacggcgcgaaaggcagacuauucucaggccaucucaagugccgccuaaaaauggacaaacuccgccuaaaagggguauccuacucacucugcacagcagcauucacauucaccaaaguccccgcggaaacccuacauggcacaguaaccguagaagugcaauaugccggaacggauggccccugcaagaucccgguacaaauggcgguugacaugcagacucugaccccaguagggcgccuaaucacagcaaacccuguaaucacugaauccacagaaaacucaaaaaugaugcucgaacuggacccaccauucggggacagcuacauaguaauaggagucggcgacaagaaaaucacccaccacuggcacagaagcgggaguacaaucggaaaagcguucgaggccacagucaggggcgcaaaaagaauggcaguacuaggagacaccgcuugggacuucggcagcgugggcgggguauucaacucacucggaaaaggcauccaccaaaucuucggugcagccuucaaaagccuguucggaggaauguccugguucucccaaauucucaucggaacgcuccuagucuggcucggacuaaauaccaaaaacggaucuaucagcuuaaccugccucgcgcuaggaggagugaugaucuuccuguccacagcaguguccgcc

SEQ ID NO: 2913 - RNA, 2061 nt, Artificial Sequence
  KU527068.1 prME-short CDS opt
accuccguaggcaucguaggccuacuccugacgaccgccauggccgccgaagucacccgccgcggcuccgcauacuacauguaccucgaccgaaacgacgccggagaagccaucagcuuucccacuacccucggcaugaacaaaugcuacauccaaaucauggaccucggucacaugugcgacgcuacuaugagcuacgaaugucccaugcuagacgagggaguugaacccgacgacgucgacugcuggugcaacacaacaucaacaugggucguauacggcaccugucaccacaagaaaggcgaagcaagacguucuagacgagccguaacacuaccaucccauucgacccgcaaauuacaaacccgcucccaaaccuggcuagaaucacgagaauacaccaaacaccucauccgcgucgagaacuggaucuucaggaacccgggauucgcacuugcugccgcagcaauagcauggcuccucggauccuccaccucccaaaaaguuauauaccucgucaugauccuccuuaucgcccccgcauacucgauccgcugcauaggugucucaaaccgagacuucguggaaggcauguccgggggcacguggguagacguggucuuagaacacggcggcugcguaaccguaauggcacaagacaaaccaacaguggacaucgaacuggucaccacaacaguauccaacauggccgaaguccgcagcuauugcuacgaagcaagcauaucugauauggcguccgacucacgcugccccacucagggcgaagccuaccuugacaagcaauccgacacccaauacgucugcaaacgcacacucgucgaccgaggcuggggcaacggaugcggacuauucggaaagggcucccuagucacaugcgccaaauucgccugcuccaagaaaaugaccggcaaaucgauacaacccgaaaaccucgaauaccguauaaugcuauccguccacggcucacaacauucagggaugaucgucaacgacacaggccacgaaaccgacgaaaaccgagccaaggucgaaauaaccccgaacagccccagagccgaagccacccuaggaggcuucggcucccuaggccuagacugcgaaccccgcaccggccucgacuucuccgacuuguacuaccucacgaugaacaacaaacacuggcuaguccacaaagaaugguuccacgacauaccccucccauggcacgccggcgcagauaccggaacuccccacuggaacaacaaagaagcccuagucgaguucaaagacgcccacgccaaacgccaaacagucguaguccuaggaucccaagaaggcgccguucacacggcacucgccggagcacuagaagccgaaauggacggcgcaaaaggccgucuauccucaggccaccuuaaaugccgccugaagauggauaaacuccggcucaaaggagucuccuacucacugugcaccgccgcauucacauucaccaaaaucccagccgaaacccuccacggcacaguaaccguugaaguccaauacgccggcaccgauggcccaugcaaaguaccggcccaaauggcaguagacaugcaaacacucacacccguaggacgccucauaacggccaacccaguaauaaccgaauccacagaaaacuccaaaaugaugcuagaacuagacccacccuucggggacuccuacaucgucaucggcguaggcgaaaagaaaaucacacaucacuggcaccgcucaggaucaacaauaggaaaagccuucgaagccacaguaagaggugcaaaacgcauggcaguacuaggagacacagcaugggacuuugggucagucggcggagcccugaacucacucggaaaagggauccaccaaaucuucggcgccgcauucaaaucccuauucggaggaaugagcugguucagccaaauccucaucgggacccuacuaauguggcucggccucaacaccaaaaacggcuccaucucccuuaugugucucgcucuaggcggcguacucauauuccucagcaccgccgucucugca

SEQ ID NO: 2914 - RNA, 2061 nt, Artificial Sequence
  KX421193.1 prME-short CDS opt
acgagcaucggcaucauaggucuccuccuaaccacggccauggccgccgaaaucacccgccgcggcuccgcauacuacauguaccuugaccgcucagaugccggaaaagcaaucucauucgcgacaacccucggaguaaacaaaugccacguacaaaucauggaccugggccauaugugcgacgccacgauguccuacgaaugccccaugcuagacgaaggggucgaacccgaugacguagauugcuggugcaacacaacaagcaccugggucgucuacggcacaugccaccacaagaaaggagaagcacgccgaucacgccgagccgucaccuuacccucucacucaacccgaaaacuacagacaagaucccagaccuggcuugaaagccgcgaauacacaaaacaccucaucaaagucgaaaacuggauauuccggaaccccggauucgcccuaguagcaguagcaauagcauggcugcucggauccucaacaucacaaaaaguaaucuaccucgucaugauccugcuuaucgcacccgccuacucaaucagaugcauaggagucagcaaccgcgacuucgucgaagggaugucaggaggcacgugggucgacguaguccuagaacacggcggcugcgucacaguaauggcccaagacaaaccuaccguagacaucgagcucguaaccaccacuguauccaauauggccgaaguccguucauauugcuacgaagccucaaucuccgacauggcaagcgacucccgaugccccacccaaggagaagcguaccucgacaaacaauccgacacccaguacgucugcaaacgaacuuugguagaccggggcuggggcaacggaugcggucucuucgguaaaggauccuuaguaaccugcgcaaaauuuaccugcagcaagaaaaugacaggaaaaucaauacaaccagaaaaccucgaauaccgcaucaugcucucaguccacgggucccaacacuccggaaugauagucaaugacacaggcuacgaaaccgacgaaaaccgcgccaaaguagaagucacacccaacagcccccgcgcagaggccacccucggcggcuucggcucccuaggccuagacugugaaccgcgaacaggccuggacuucuccgaccucuacuaccuuacuaugaacaacaaacacuggcucguccacaaagaaugguuccacgacaucccucuaccauggcacgccggagcagacaccggcacaccccauuggaacaacaaagaagcccuuguugaguucaaggacgcccacgcgaaacgacaaaccgugguaguacuugguucacaagaaggcgcaguccacacagcccuagccggagcccucgaagcagagauggacggagccaaaggcaaacucuucuccggccaccuaaagugcagacuaaaaauggacaaacuaagacuaaaagggguaucauacagccuaugcaccgccgcuuucaccuucacgaaagucccagccgaaacccuacacggcaccguaaccgucgaaguacaauacgcaggaaccgacggccccugcaaaauccccguccagauggccguagauaugcaaacacuaacccccgucggacgccuaauaaccgccaacccagucaucaccgaaagcacugaaaacuccaaaaugaugcuagaacucgacccgccauucggcgacagcuacaucguaaucggagucggggauaaaaagaucacccaccacuggcaccgcucaggcagcacgauaggcaaagccuucgaagccacaguccgcggggccaaacguauggcaguccuaggagacacggccugggacuucggcuccgucggcggagucuucaacucccuaggcaaaggcauccaccaaauauucggcgcggcauucaaaagccuauucggcggcauguccugguucucacaaauccuaauaggcacccuccuaguauggcuaggacuaaacaccaaaaacggauccauaagccuaaccugccuagcacuaggcggcguaaugauuuuccuaagcacggccgucagcgca

SEQ ID NO: 2915 - RNA, 2061 nt, Artificial Sequence
  KX377335.1 prME-short CDS opt
acgaguaucgguaucauaggccuacugcugacaaccgcgauggcugcagagaucacacguagaggaagcgcauacuacauguaccuggaccgcagcgacgccggaaaagcaauaucauucgccacaacgcucggaguaaacaaaugccacguccagauaauggaccucggucacaugugcgacgcaaccaugucguacgaaugccccaugcuagacgagggagucgaaccagacgacgucgauugcuggugcaacacaaccagcacgugggucguguacggaaccugccacagaaagaaaggggaagcgagaagaagcagacgagcggucacacucccuagccacagcacacgcaaacuccaaacccgaagccaaacguggcucgaaagccgagaauacacaaaacaccucaucaaagucgaaaacuggaucuuccgcaaccccggguucgcacucguggcagucgccauagcauggcuccugggcagcagcacgagccaaaaaguaaucuaccuagugaugauacuccugaucgccccagccuacucgauacgaugcauaggcgucagcaaccgcgauuucguggaaggaauguccggcgggacguggguagacguaguccuggaacacggaggcugcgucaccguaauggcccaggacaaacccacagucgauauagagcuggugacgacaacaguaagcaacauggcagaaguacgcucguacugcuaugaagcaucgaucucggacauggcaagcgacagccgcuguccaacccaaggagaggccuaccuagacaaacagagcgacacacaguaugucugcaaaagaacccucguagacagaggcuggggaaacggaugcggccucuucggcaagggaucgcuaguaacaugcgccaaauucacaugcuccaagaaaaugacaggcaaaagcauccagcccgaaaaccuagaguaccgaauaaugcugucaguccacggcucacaacacuccggcaugauaguaaacgacaccggcuacgaaacggaugaaaacagagccaaagucgagguaaccccgaacuccccacgagcagaagcaacucucggaggguucgggagccucggguuagacugcgaaccccgcaccggauuggacuucagcgaccucuauuaccugacaaugaacaacaaacacuggcucguccacaaagagugguuucacgacaucccccuccccuggcacgcaggcgccgacacaggaacgccacacuggaacaacaaagaggccuuggucgaguucaaagacgcacacgccaaaagacaaaccguggucguacucggcagccaagaaggagcaguacacacagcgcuagcaggcgcacuagaagccgaaauggacggagcaaaagggaaauuguucucuggccaccucaaaugcagacugaaaauggacaaacuaagacugaaaggagugucauacucacugugcacagcagcauucaccuucacaaaaguaccagcggaaacccuucacgggacaguaaccguagaaguccaauacgcaggaaccgacgggccgugcaagaucccagugcagauggccgucgacaugcagacccuaaccccagucgggcgacucaucaccgccaacccaguaauaacagaaaguaccgaaaacagcaaaaugaugcuugaacuagacccacccuucggagacagcuacauaguaauaggcgugggagauaagaaaauaacccaccacuggcacagaagcgggagcacaauaggaaaagcauucgaggccaccgucaggggagcaaaaagaauggcaguacucggagacaccgccugggacuucgggucugucggaggaguauucaacucacuagggaaaggaauccaccaaauauucggcgccgccuucaagagcuuauucgggggcauguccugguucagccaaauccuaauuggaacccuccuaguguggcuaggccuaaacaccaaaaacggaagcauaagucuaacaugucuagcccuaggcggcgugaugauauuccuaagcaccgcgguaagcgcc

SEQ ID NO: 2916 - RNA, 2061 nt, Artificial Sequence
  LC002520.1 prME-short CDS opt
acaagcaucggcauaaucggacuauuacucacaaccgcaauggcagccgaaauaacccgccgaggaucugccuacuacauguaccucgacaggagcgacgccggaaaagcaauaucauucgcaacaacccuagggguaaacaagugccacguacaaauaauggaccucggccacaugugcgacgccacaaugagcuacgaaugccccaugcuggacgagggcguggaaccggacgacgucgacugcuggugcaacaccacuuccaccugggucguauacggaaccugccaccacaagaaaggggaagcacgaagauccagacgagccgucacauuaccaagccacucaaccagaaaacuacagacaagaagccaaacauggcucgaaagcagggaguacacaaaacaccugauaaaagucgaaaacuggauauuccgcaaccccggguucgcccucguggccguagcaauagccuggcuacuaggcuccagcacaagccaaaaagucaucuaccuagucaugauccuccuaaucgcgccagcauacuccauccgguguauaggcgucucaaacagagacuucgucgaagggaugucaggcggaaccuggguagacgugguacucgagcacggaggcugcguaacagucauggcccaagacaaacccaccgucgacaucgaacugguaacaaccaccguaagcaacauggcugaaguccgauccuacugcuaugaagccagcaucucagacauggcaagugacucacgaugcccaacccaaggcgaagccuaccuggacaagcaaagcgacacccaguacgucugcaaacgcacccuagucgaccgaggguggggaaacggcugcggccucuucggaaaaggaucgcuagucacgugugcaaaguuuaccugcuccaagaaaaugacaggcaaaaguauacagccugaaaaccucgaguaucgaaucaugcuaucugugcacggcucacaacacucaggaaugacggucaacgacauaggauacgagaccgacgaaaaccgcgcaaaagucgaggucaccccaaacagcccacgggcagaagccacccucggaggguucggcagccuaggccucgauugcgaaccaagaacaggccuugacuucuccgaccuauacuaucucaccaugaacaacaaacacuggcugguccacaaagaaugguuccacgacauaccacuccccuggcacgcaggcgcggacacagggacgccacacuggaacaacaaagaagcccuaguagaguucaaagacgcacacgccaaacgacaaaccgucgucguucuaggcucccaagaaggcgcaguccacacggcccuagcaggagcgcuagaagccgagauggacggcgccaagggcaaacucuucagcggacaccuaaaaugcaggcuaaaaauggacaaacuacggcucaagggaguaucauacucgcugugcaccgcggcguucaccuucaccaaaguacccgccgagacccuccacggaaccguaaccgucgaaguccaauacgcagggacugacggcccgugcaaaaucccaguccaaauggcagucgacaugcaaacacuaacaccagucgggcgacucaucacagcaaaccccguaaucacagaauccaccgaaaacuccaagaugaugcucgagcuagacccgccauucggagacagcuacaucguaauaggagucggagacaaaaagaucacccaccacuggcaccgcucgggaagcacaaucggcaaggccuucgaagcaacuguaagaggcgcaaaacgcauggccguacuaggagacaccgcuugggacuucggcagcgucggcgggguguucaacucccuaggaaaaggcauacaccaaauauucggagcagcuuuuaaaucccuguucggcggcaugagcugguucagccaaauacuaauaggcacccucuuagucuggcuaggacucaacacaaagaacggcucaaucucacuaaccugccucgcacuaggaggagucaugauauuccugagcacagccgucagcgcc

SEQ ID NO: 2917 - RNA, 2043 nt, Artificial Sequence
  DQ859059.1 prME-short CDS opt
acaagcauaggcauagucggccugcuacucaccacugccauggccgccgaaauaacacgcagaggcuccgccuacuacauguaccucgaccgcuccgacgcaggaaaagccaucuccuucgcaaccacgcucggcgucaacaaaugucacguacaaauaauggaccuaggccacaugugcgacgccaccaugagcuacgaaugccccaugcucgacgagggcgucgagccggacgacguagacugcuggugcaacacaaccucuacauggguagucuauggaaccugccaucacaagaaaggcgaggcccgacgaagccgacgagcaguuaccuuacccagccacagcacacgcaaacuccaaacaagaagccaaacauggcuagagagccgagaauacacaaaacaccucaucaaagucgaaaacuggauauuccggaauccaggcuucacacucgucgcaguagcaauagccuggcuccucggcagcagcaccagccaaaaaguaaucuaccuagucaugauccuccuaauagcgccagccuacuccauaaggugcauaggaguaagcaaucgcgacuucguagaaggaaugagcggaggcaccugggucgacguaguccucgaacacgggggaugcguaacaguaauggcccaagacaagccaacaguagacauagagcucgucacaacgaccgucaguaacauggcagaagucaggucuuacugcuacgaagcaagcaucagcgacauggcaucagacagccgaugccccacccaaggagaagcguaccuagacaagcaaucagacacccaauacgucugcaaaaggacccuuguagauagaggauggggaaacggaugcggccucuucggcaagggcagccuaguaaccugcgcaaaauucacaugcucaaagaaaaugaccggcaaaucaauccaaccagaaaaccuugaauaccgaaucaugcucuccguccacggaagccaacacagcggaaugauagucaacgacgaaaacagagcaaaagucgaagucacucccaacucaccccgagccgaagccacccugggcggcuucggaucccugggacuugacugcgaaccucgcaccggccuagacuucagcgaccuauacuaccucacaaugaacaacaaacacuggcuaguccacaaagaaugguuucacgacauaccccucccauggcacgccggcgcagacaccggaacaccccauuggaacaacaaagaagcccuagucgaguucaaagacgcacacgcaaaacggcagacaguagucguacuaggcucccaggagggcgcaguacacaccgcacuggccggcgcccuggaagccgaaauggauggcgcaaaaggaaggcuguucucgggacaccucaaaugcaggcugaaaauggacaaacuaagacucaaagggguaucauacuccuuaugcacagccgccuucaccuucaccaaaguaccagcagagacgcuccacggcaccgugaccgucgagguacaauacgccggcaccgacggaccaugcaaaguccccgcccaaauggcaguagauaugcagacacugaccccagucggcagacuaauaaccgccaacccgguuauaaccgaaagcaccgaaaacucaaaaaugauguuggaacuggacccacccuucggcgauagcuacauagucauagguguaggagacaagaaaaucacccaccacuggcacagaucagguagcacaaucggcaaagcguucgaagccaccguccgcggcgcaaaaaggauggccguacucggcgacaccgccugggacuucggcagcgugggaggagucuucaacagccuaggaaaaggcauccaccaaaucuucggagccgccuucaaaagccucuucggaggaaugagcugguucucccaaauccucaucggaacccuacuggucuggcucggccucaacaccaaaaacggcagcaucucucuaaccugccucgcacuaggcggcgucaugauauuccucagcaccgcggucucagca

SEQ ID NO: 2918 - RNA, 2049 nt, Artificial Sequence
  KU963573.2 prME-short CDS opt
accucaaucggaaucaucggacuauugcucaccaccgcgauggcagcagaaaucacacgcagaggauccgcauauuacauguaccuugaccgcagugacgccggcaaagcaaucucuuucgccacaacacucggagucaacaaaugccacguccaaaucauggaccucggccacaugugcgacgccacaauguccuacgaaugccccaugcucgacgaaggcgucgaacccgacgacgucgacugcuggugcaacaccacauccacuugggucgucuacggaaccugccaccacaagaaaggcgaggcgagacgcuccagacgcgccgucacacuacccucgcacuccacaaggaaacuccagacccgaagccagaccuggcuagagucccgggaauacaccaaacacuuaaucaaaguagagaacuggauauuuagaaaccccggauucgcucucgucgccgucgcaauugcuuggcuccuaggcucaagcaccagucaaaaaguuauuuaccuagucaugauacuacuaaucgcacccgccuacuccauccgcugcaucggagucaguaaccgcgacuucguggaaggcauguccggaggaacgugggucgacguaguccucgagcacggaggaugcgucacagucauggcacaggacaaaccaaccgucgacauagagcuagucaccacgacagucucaaacauggccgaaguaaggucuuacugcuacgaagccagcaucuccgauauggccucagacucccgaugccccacccaaggagaggccuaccucgacaaacaaucagacacccaauacguaugcaaaagaacccuaguugaccgcggcuggggaaacggcugcggccucuucggcaaagggagccuaguaaccugcgcaaaauucacaugcuccaagaaaaugaccggcaaauccauccaaccagaaaaccucgaguaccgcauaaugcucucaguacacggcucacaacacagcggaaugauaggcuacgaaaccgacgaaaaccgcgccaaagucgaagucacccccaacagcccacgcgccgaagccacacucggcggauucggcucccuaggccuagacugcgaaccccgcaccggucuugauuuuucagaccuuuauuaccucacaaugaacaacaaacacuggcucgugcauaaagaaugguuucacgauauaccacuaccguggcaugcgggagcagacaccggcacgccccacuggaacaacaaagaagcacucgucgaguucaaagacgcccaugccaaacgccaaaccguaguaguucuaggaucacaagaaggagcaguccacaccgcccucgccggagccuuagaagcagaaauggacggagcgaaaggcaaacuguucagcggccaccuaaagugcagacucaaaauggacaagcuccgccucaaaggcgucucauacucacuaugcaccgcagccuucaccuucaccaaggucccagcagaaacccuccacgggaccgucacugucgaaguccaguaugcaggcacggacggaccaugcaagaucccgguccagauggcaguagacaugcaaacccucacacccgucggccgacucaucacagcaaaccccgugaucacagaauccacugaaaacucaaaaaugaugcucgaacucgacccgcccuucggcgacagcuacaucgucaucggcgucggcgacaaaaagauaacccaccacuggcaccgcagcgggucaacuaucggcaaagcauucgaagccaccguccgcggcgccaaacgaauggccguacucggagacacggccugggauuucggcuccguaggcggaguauucaacagccuaggaaagggcauccaccaaaucuucggagcagcauucaaaagccuauucggcggcaugucaugguuuucccaaauacugaucggcacacucuuagucuggcucggacucaacaccaagaacggcuccaucagccuaaccugccucgcacuaggcggagucaugaucuuccuaagcaccgccguaagcgca

SEQ ID NO: 2919 - RNA, 2061 nt, Artificial Sequence
  KX694534.2 prME-short CDS opt
accuccgucggaauagucggccucuuacuaaccacugccauggccgcagaaguaacccgccgagggagcgcauacuacauguaccucgaccgcaacgacgcaggagaagccaucagcuuccccacgacgcuaggcaugaacaagugcuacauacagaucauggaccuaggccauaugugcgacgccacaaugucauacgaaugcccaaugcuagacgaaggcgucgaacccgacgacgucgacugcuggugcaauacaacaagcacuuggguagucuacggaaccugccaccacaagaaaggggaagcacgacgaagccgccgagcagucacucuccccucacacagcacccggaaacuccaaacacgcagccaaaccuggcuagaaagccgagaauauacaaaacaccucauacgaguagaaaacuggaucuuccgaaacccaggcuucgcauuagccgccgcggccaucgccuggcuacugggcucgucaacaucacagaaaguuaucuaccuaguaaugauacuucuaaucgcccccgccuacagcauaagaugcaucggcguaagcaacagagacuucguagaggggaugagcggcgggaccuggguagacgucguccuggagcacggcgguugcgucacgguaauggcccaagacaaaccaaccguugacaucgaacucguaacgacgaccguguccaacauggcagaaguccgaucauacugcuacgaagccagcaucagcgacauggcauccgacucuagaugcccgacccagggagaagccuaccuugacaaacaaagugacacacaauacgucugcaaacgaacccucgucgaccgcggcuggggcaacggcugcggccucuucgggaaaggcagccuaguaaccugugcgaaauucgcaugcagcaagaaaaugacagggaaauccauacagccagaaaaccuagaauaccgcauaaugcugaguguccacggaucucaacacagcggcaugaucguaaacgacacaggacacgaaacagacgaaaaccgagcaaaaguagagaucaccccgaacagcccccgagcggaagcaacacuaggcggauucggcagccugggccucgacugugaacccagaacaggcuuagacuucagcgaccucuacuaccucaccaugaacaacaaacacuggcucguccauaaagaaugguuccacgacaucccgcucccauggcacgccggcgcagacacaggaacgccacacuggaacaacaaagaggcgcuaguggaguucaaagacgcacacgccaaacgccagaccguagucguacuaggaucacaagaaggcgccguucacacagcccuagccggagcacucgaagccgaaauggacggcgcaaagggcagacuaucaucaggccaccuaaaaugccgccuaaagauggacaaacugcgccuaaaaggcgugucauacucacuaugcacagcagcauucacguuuaccaagauaccagcagaaacacuacacgguacagucaccgucgaaguccaauacgcagggaccgacggaccaugcaaaguacccgcccaaauggcaguggacaugcaaacacucacaccgguaggacgacuuaucaccgccaacccgguaauaacagaauccaccgaaaacagcaaaaugaugcucgaacucgacccacccuucggagacuccuacauaguaauaggcgucggagaaaagaaaaucacacaccacuggcaccgcuccggcuccaccaucgggaaagcauucgaagccacagucagaggagccaaacgaauggcgguccugggcgacacggcaugggacuucggaagcgucgggggcgcacucaacucacucggccguggaauacaccaaaucuucggggccgcguucaaaagccucuucggcggcaugagcugguucucgcaaauccucauaggcacccuacucauguggcucggacuaaacaccaaaaacggaucaaucagccucaugugcuuagcccuaggcggcguccucauuuuucucagcaccgcgguaagcgca

SEQ ID NO: 2920 - RNA, 2061 nt, Artificial Sequence
  KX369547.1 prME-short CDS opt
accuccguaggaaucguuggcuuacuccucaccaccgcaauggcagcagaaguaacucggcgcggcucagccuacuacauguaccucgaccgcaacgacgcaggagaagccauaagcuuccccaccacccuuggcaugaacaaaugcuacauccaaauaauggaccuuggucacaugugcgacgcgaccaugagcuacgaaugccccaugcuagacgaaggagucgaaccagacgacguagacugcuggugcaacaccacaagcaccugggucguauacggcaccugccaccacaaaaaaggcgaagccagacgcucacgacgagccgucacucuucccucccacuccacccgcaaacuacaaacgcgaucccaaaccugguuagaaagccgcgaauacaccaaacaccuuauaagggucgagaacuggauauuccgcaaucccggacuagcucuugcagccgcagcaauagccuggcuacuaggaucguccaccucacaaaaagucauauaccuagucaugauccuccuaauagcuccagccuacagcauacguugcaucggcguuuccaaccgggacuucguagaaggcaugagcggcggcaccugggucgacguuguacuggaacacggaggaugcgucaccgucauggcccaagacaaacccacugucgacaucgaacuaguaaccacaaccgucagcaacauggccgagguacgcagcuacugcuacgaggcguccaucagcgacauggcguccgacucacggugccccacccaaggcgaagcauaccuagacaaacaaucugacacccaauacguaugcaaacgaacccucguggaccgaggauggggcaacggcugcggccuguucggcaaaggcucacuagucaccugugcaaaauucgccugcuccaaaaaaaugacagggaaauccauacaacccgaaaaccuagaauauagaaucaugcuaagcgugcacgguucccagcauuccggcaugauaguaaacgacaccggccacgaaaccgacgaaaaccgugcaaaagucgaaauaacuccaaacucaccccgcgccgaagcaaccuuaggcggcuucggcucacucggccuagacugcgagccccgcaccggguuagacuucuccgaccuguacuaccuuaccaugaacaacaaacacuggcuaguacacaaagaaugguuccacgacauaccccuaccauggcacgcgggggccgacacaggaaccccccacuggaacaauaaagaagcccucgucgaauucaaagacgcccacgcuaagcgccaaaccguagucguccuagggucacaggagggagccguccacacugcccuagccggcgcucucgaagcagaaauggauggcgcaaaagggcgacuuagcuccggacaccuaaaaugucgccucaaaauggacaaauugcgacuuaaaggagucucuuacucucucugcaccgccgccuucacauucacaaaaaucccagccgaaacccuccacggcaccgucaccguagaaguccaauaugcaggcaccgacggacccugcaaagucccugcacaaauggccgucgacaugcaaacacucacaccaguaggccgacucauaacugccaacccgguaaucaccgaauccacugaaaacucgaaaaugaugcucgaacucgacccaccauucggagacucauacauagucauaggugucggagaaaaaaaaauaacccaucacuggcacagaucaggcucaaccaucggcaaggcauucgaagccaccguaaggggcgcaaaacgcauggccguccuaggagacaccgcaugggacuucggaucgguaggcggcgcacucaacagccuaggcaaaggcauacaccagauauucggcgcagccuuuaaaagccucuucggcggaaugucaugguucagccagauccucauaggcacacuccuuauguggcuaggccuaaacacaaaaaacggauccaucucccucaugugccucgcccucggaggaguacugaucuuccuaucgaccgcagucagcgcc

SEQ ID NO: 2921 - RNA, 2061 nt, Artificial Sequence
  KX447515.1 prME-short CDS opt
acaagcguagguauagucggccuccuccucaccaccgcaauggcagccgaggucacacgcagaggcagcgcauacuacauguaccuagaccggaacgacgcaggagaagcaaucucguucccaaccacccuugggaugaacaaaugcuacauacagauaauggaccugggacauaugugcgacgccacaauguccuacgaaugcccaaugcucgacgaggggguagaacccgaugacguagacugcuggugcaacaccacaagcacaugggucgucuacggcacaugccaccacaagaaaggggaagcccggaggagcagacgagcagucacacuccccagccacagcacaagaaaacuacagacccgcucacaaaccuggcuagaaagccgagaguacacaaaacaccucauacgaguugaaaacuggaucuuccgcaaccccggauucgcgcuagccgcggcagcaauagcauggcuccugggaucuagcaccagucaaaaaguuaucuaccuugucaugauacuccuaauagcccccgcauacagcauacgaugcauaggcguaagcaaccgcgacuucgucgaagggaugucaggagggaccugggucgacguaguacuagaacacggcggaugcgugacagucauggcccaagacaaacccacaguagacauagagcucgucacaaccacaguauccaacauggccgaaguccgcucguacugcuacgaagcaucaaucagcgacauggccucagacucccgcugccccacgcagggagaagcauaccucgacaaacaaucagacacacaguacgucugcaaaaggacccuaguagaccgaggaugggggaacgggugcggacucuuuggaaagggaucgcucguaacaugcgcaaaauucgccugcagcaaaaagaugacaggcaaaucaauacagccggaaaaccucgaauaccggaucaugcucuccguacacggcucacaacacucgggcaugauagucaacgacacaggccacgaaacagacgaaaacagggccaaagucgaaaucaccccgaacucaccgcgcgcagaggcuacccuaggaggguucggaucccucggccuagacugcgaaccgcgaacaggacuggacuucagugaccucuacuaccuaaccaugaacaacaaacacuggcuaguccacaaagaaugguuccacgacauaccccuccccuggcacgcaggagccgauaccggcacgccgcacuggaacaacaaagaggcccuagucgaguucaaagacgcacacgcaaaaaggcaaacggucgucguacucggcucgcaagaaggagcaguacauacagcacuagcaggcgcacucgaggccgaaauggacggagccaaagggcgccuuuccagcggccaccucaaaugccggcuuaaaauggacaaacuuaggcuaaaaggggucuccuacagccucugcaccgccgccuucacauucacuaaaaucccagcagagacccuacacggaacagugaccguagaagugcaauacgccgggacagacggacccugcaaaguacccgcacaaauggccguugacaugcagacacuaacccccgucggacgacuaaucaccgccaauccggugauaaccgaaucgacugaaaacagcaaaaugaugcucgaacucgacccacccuucggcgacagcuacaucguaauaggagucggcgaaaagaaaauaacccaccacugguaccgcuccggaagcaccaucggcaaagcguucgaagccacggucagaggugcaaaacgcauggccguccuaggcgauacggccugggacuucggaagcguugggggagcacuaaacucacuaggcaaagggauacaccaaauauucggugccgcauucaaaucccuguucggaggaaugucaugguucucacaaauacuaauaggcacacuacuaauguggcugggccucaacaccaagaacggaagcauuucccuaaugugccucgcccucggcggcguacuaaucuuccuauccacagcaguaagcgca

SEQ ID NO: 2922 - RNA, 2061 nt, Artificial Sequence
  KU729218.1 prME-short CDS opt
acgucuguaggcauaguuggccuacuccucacaacagccauggcagccgaaguaacccgccgcggcucagccuauuacauguaccuggaccgaaacgacgcuggagaagccaucucauuccccaccacccucggaaugaacaaaugcuacauacaaaucauggaccucggacacaugugcgacgcgaccaugaguuacgaaugcccaauguuggacgaaggagucgagcccgacgacguugacugcugguguaacaccaccaguacuugggucgucuacggaaccugccaccacaagaaaggggaagcccgacgaucccgccgggcgguaacccuaccuucccacagcacccgcaaacuccaaacacgaucacaaaccuggcucgaaagcagagaauacacgaaacaucucauacgaguagagaacuggauauucagaaauccgggauucgcacuagccgccgccgccaucgccuggcuccugggaucaucaaccagccaaaaaguaauauaccucgugaugauccuccuaauagcccccgcguacucaauacgcugcauaggcgucagcaaccgggacuucguagaaggcauguccgggggcaccugggucgacguaguacucgagcacggcggcugcgugaccguaauggcccaagacaaacccaccguagacaucgaacugguuacaaccacagugucaaacauggcagaagucagaagcuacugcuacgaagccucgauaagcgacauggccuccgacagccgaugccccacccaaggagaagccuaccuagacaaacaaucagacacacaauacgucugcaaacgaacccuaguagaccgcggcuggggcaacggaugcggccuuuucggaaaaggcucacuuguaaccugcgccaaauucgcaugcagcaagaaaaugaccggaaaaucaauccaaccagaaaaccuagaguaucgcaucaugcucuccguacacggaucacaacacucaggcaugauagucaaugauacgggccacgaaaccgacgaaaauagagcaaaagucgagaucacccccaacagcccccgcgccgaagcaacacucggaggauucgggagccucggacucgacugcgaaccccgaacaggccuagacuucucagaccuauacuaccucaccaugaacaacaaacacuggcucguacacaaagaaugguuucacgacauaccacuacccuggcacgcuggggccgacaccgggacuccccacuggaauaacaaagaagcccuaguagaguucaaagacgcccacgccaaacgccaaacggucguaguacucggcagccaagaaggggccguccacaccgcgcucgccggagcccucgaagccgaaauggacggagcaaagggacggcuauccucagggcaccucaaaugcagacuaaagauggacaaacuccgucugaagggcguuuccuauagccucugcaccgcagcauucaccuucacaaagaucccggccgaaacacuccacgggaccgucaccguagaagugcaauacgccggcacagauggccccugcaaaguccccgcccagauggccgucgacacccaaacgcugacacccgucggccgccuaaucaccgcgaaucccgucauaacugaauccaccgaaaacucgaaaaugauguuagaacucgaucccccauucggggacucauacaucguaauaggcgucggagaaaagaaaauaacccaccacuggcaccgaucaggcagcaccauaggcaaagccuucgaagccacuguaaggggcgcaaaacgcauggcaguacuaggagacaccgcaugggacuuuggcucagucggcggagcccucaacucccuaggcaaaggaauacaccagauuuucggagcagcuuucaaaagccucuucggcggcaugagcugguucucccagauucuaauaggcacccugcucauguggcucggacugaacaccaaaaacggauccaucucccucaugugccuagcacugggcggcguccuaauauuccugucuaccgccguauccgcc

SEQ ID NO: 2923 - RNA, 2061 nt, Artificial Sequence
  KU501217.1 prME-short CDS opt
acauccgugggcauagucggucuccuacuuaccacagcaauggcagccgaaguaacacgccgaggcucagcauacuacauguaccucgaccggaacgacgcaggcgaagcaauauccuucccaaccacacucggcaugaacaaaugcuacauccaaaucauggaccucggccacaugugcgacgccacaauguccuacgaaugccccaugcucgacgaagggguggaaccagacgacgucgacuguuggugcaacaccaccuccaccugggucgucuacgggaccugccaccacaagaaaggcgaagcccgccgaagcagacgcgcagucacacucccuucccacucaacccgcaaacugcaaacccgcucacaaaccuggcucgaaagccgcgaauacaccaaacaccuuauaagaguagaaaacuggaucuuccgaaacccaggcuucgcacucgccgcagccgccauagccuggcuacuugggagcuccacgucccaaaaaguaauauaccucguaaugauucuccuaauagcgccagccuacuccauccggugcauaggagucucaaacagagacuucgucgaagguaugucgggaggaaccugggucgacguaguacuagaacacgggggcugcgucacugucauggcacaagacaaaccgaccgucgacauagaacucguaacaaccaccgugucuaacauggccgaaauccgaagcuacugcuacgaagcaagcauaagcgacauggccuccgacucgcgaugcccaacccaaggagaagccuaccuugacaaacaaagugauacacaauacgucugcaagagaacauuaguagaccgaggaugggggaacggaugcggccuauucggcaaaggcucacucgucacgugcgccaaguucgcuugcuccaagaaaaugaccggcaaaagcauacaaccugaaaaccucgaauacagaauaaugcuauccguccacggcucccaacacagcggaaugaucgucaacgacacaggacacgaaacagacgaaaaccgcgccaaaguagaaaucacccccaacucaccccgagcagaagccacucucggcggcuucggcucccuaggacuagacugcgaaccccgaaccggccuggacuuuuccgaccucuacuaccugaccaugaauaacaaacacuggcuaguacacaaagaaugguuccacgacauacccuuacccuggcacgccggcgccgacaccggcacaccccacuggaacaacaaagaagcccuggucgaguucaaggacgcacacgcaaaacgucaaaccguaguaguccucggcucccaagaaggcgccguccacaccgcccuagcaggggcacuagaagcagaaauggacggggccaaaggaagacuauccagcggccaccucaaaugccgacucaaaauggacaaacucagacucaaaggaguaucauacagccuauguaccgcagcguucaccuucaccaaaaucccagccgaaacacuacacgggacaguaaccguagaaguacaauacgccggaacugacggacccugcaaaguacccgcacaaauggcuguggacaugcaaaccuuaaccccagugggcagacugaucacagccaaccccguaauaacggaaucgacggaaaacuccaaaaugaugcucgaacuagacccucccuucggcgacucauacaucgucaucggcgucggcgagaaaaagaucacccaccauuggcaccgaagcggcagcacgauaggcaaagcauucgaagcaacaguaagaggcgccaaacgaauggccguccuaggagacaccgcaugggacuucggcagcguaggaggcgcacuaaacucacucggaaaaggaauccaccaaaucuucggagcagccuucaaaucccuauucgggggcaugaguugguucucccaaauacucaucggcacccuacuuauguggcucggccuuaacaccaagaacggaagcauaagccugaugugccucgcccugggcggcguccucaucuuccuuucuaccgcaguaucagcc

SEQ ID NO: 2924 - RNA, 2061 nt, Artificial Sequence
  KU312314.1 prME-short CDS opt
accagcgugggaaucgucggacuacuccuaacaaccgcgauggcugccgaaguaacccgacgcgggagcgccuacuacauguacuuagacagaaacgacgcaggggaagcaaucagcuucccuacaacgcucggaaugaacaaaugcuacauacaaauaauggaccucggacacaugugcgacgcaacaaugaguuacgaaugcccaaugcuagacgaaggcguagaaccagacgacguagacugcuggugcaacaccacgagcacguggguagucuacgguacgugucaccacaagaaaggcgaagcacgacgcuccaggagagccguaacgcucccgagccacucgacacgaaaacuccaaacacgcagccaaaccuggcuagaaucacgagaauacacgaagcaccuaauccgaguagaaaacuggauauuccgaaaccccggauucgcgcucgccgccgcggccaucgcauggcuccuugggagcagcacaagccaaaaagugauauaccuaguaaugauccuacucaucgccccagcauacaguauacgaugcaucggagugagcaaccgcgacuucguggaaggaauguccgggggcaccugggucgacgucguccuggaacacggcggaugcgucacggucauggcacaagacaaaccaacaguggacauagaacucgucaccaccacagucagcaacauggcagaaguccgcagcuacugcuacgaagccagcaucucagacauggccuccgacagcagaugccccacccaaggcgaagcguaccuagacaaacaguccgacacgcaauacgucugcaaacggacacucguagacagaggauggggaaacggcugcggccuguucggcaaaggcucccuagucaccugugcaaaguucgccugcagcaagaaaaugacaggcaaaucaauccagccggaaaaccucgaauacagaauaaugcucagcguccacggcucccaacauagcggcaugauaguaaacgacacgggccacgaaacagacgaaaaccgagccaaagucgaaauaacacccaacagcccccgcgcggaagccacacucggaggcuucgggucgcuaggacucgacugugaaccaagaacaggccuggacuucagcgaccucuacuaccucaccaugaacaacaaacacuggcuugugcauaaagaaugguuccacgacauaccacucccguggcaugccggagcagacaccggaacaccacacuggaacaacaaagaagcccuaguggaguucaaagacgcacacgcaaaacgacaaacaguagucguacuaggaucccaagaaggcgcuguacacaccgcacuagccggcgcacuagaagccgaaauggacggagcaaaaggacgccuauccucaggccaccucaagugcaggcuaaagauggacaaacuccgauuaaagggagucuccuacagccugugcaccgccgccuucaccuucaccaaaaucccagccgaaacacugcacgggaccgugacaguagaaguacaauacgccggcacagauggacccugcaaaguacuagcacaaauggccgucgacaugcaaacacuaaccccagucggccgccucauaacggcaaaccccgugaucacagaauccacagaaaacucgaaaaugaugcuagaacucgacccacccuucggcgacucauacauaguaaucggaguaggagaaaagaaaauaacccaccacuggcacagaagcggaagcacaauaggcaaagccuucgaagcaaccguccgaggagccaaaagaauggcagucuuaggcgacaccgcaugggacuucgggagcgugggcggagcacuaaacagcuugggaaaaggaauccaccaaauauucggagcagcguucaaaagccuguucggaggcaugaguugguucagucagauccucaucggcacacuccucauguggcuaggacuaaacaccaaaaacggcagcaucucacugaugugccucgcgcucggaggcguacugauauuccugagcaccgccguauccgca

SEQ ID NO: 2925 - RNA, 2061 nt, Artificial Sequence
  KX446950.2 prME-short CDS opt
accucagucgggauugucggacuccuacucaccacagccauggcagccgaggugacccgacgaggaucagccuacuacauguaucucgaucgcaacgacgcaggcgaagccauaucguuccccacaacccucggcaugaacaaaugcuacauccaaaucauggacuuaggccauaugugcgacgccaccaugucauacgaaugccccacacuagacgaaggcgucgaacccgacgacgucgacugcuggugcaauaccaccuccacaugggucguauacggcacaugccaccacaagaaaggcgaagcccgccgaucccgcagagccguuaccuuaccaagccacuccacccgaaaacuccaaacgcggagccaaaccuggcuagaaagccgcgaauacacaaaacaccucauccgcgucgaaaacuggauauuccgcaacccaggauucgcccucgccgccgccgcaauagcauggcugcucggcuccagcacaucccaaaaagucaucuaccucguaaugauccuucucaucgcccccgccuacuccauccgcugcaucggcgucucaaaccgagacuucgucgaaggcaugucaggcggcaccugggucgacgucguccuggaacacggaggcugcguaaccgucauggcccaagacaaaccgacaguagacaucgagcuagugaccacaacagucagcaauauggccgaagucagaucuuacugcuaugaagcguccaucucugacauggccuccgacucacgcugucccacgcaaggggaagccuaccuggacaaacaaagcgacacgcaguacgucuguaaacgcacccuagucgaccgcggcuggggcaacggaugcggacuauuuggaaaaggcucacucgucacuugcgccaaauucgccugcucaaagaagaugaccggaaagucuauccaaccggaaaaccuagaauaccgcauaaugcuauccguccacgggucacaacacucaggaaugauagucaaugacaccggacacgaaaccgacgaaaaccgugcuaaaguagaaaucacccccaacuccccuagagccgaagcaacccuagggggauucggaagucuaggccuggacugcgaaccacgcaccggccuggacuucuccgaccucuacuaccucacaaugaacaacaagcacuggcuaguccacaaagaaugguuccacgacaucccacuaccuuggcacgccggcgccgacacaggcacaccccacuggaacaacaaagaagcccucguagaguucaaagacgcucacgccaaacgucaaaccgucgucguccuagggagccaagaaggcgcaguccacaccgcguuggcaggcgcccuagaagcagaaauggacggagcaaaaggacgacucuccucgggccaccuaaaaugccggcuaaaaauggacaaacuacgccucaaaggcgucuccuacagccucugcaccgcagccuucaccuucaccaagaucccagccgaaacccuucacggcaccguaaccguagaaguccaauacgcaggcacagacggcccaugcaaaguaccagcccaaauggcaguagauaugcaaacacuaaccccuguuggccgccucaucacagccaaccccguaaucaccgaaagcaccgagaacucaaaaaugaugcuagagcucgacccacccuuuggcgauuccuacaucgucaucgggguaggcgaaaagaaaaucacgcaccacuggcacagguccggaagcacaaucggcaaagcguucgaggcaacuguccgaggcgccaaacgaauggcaguccucggugacaccgccugggauuucggaagcgucggcggugcccucaauagccuaggcaagggcauccaccaaaucuucggcgccgccuucaaaucccuguucggaggcaugucaugguucucacagauccuaauaggcacccugcuaauguggcuaggccucaacaccaaaaacggaucgaucuccuuaaugugccuagcacucggcgggguccuaaucuuccuauccacagccguaucagcc

SEQ ID NO: 2926 - RNA, 2061 nt, Artificial Sequence
  KY003157.1 prME-short CDS opt
accucgguagggaucgucggccuacuccuaacaacagccauggccgccgaagucacccgccgaggaagugccuacuacauguacuuagaccgaaacgacgccggggaggccauaucguuccccacaacacuaggaaugaacaaaugcuacauucagauaauggaccuaggacacaugugugacgcaaccaugaguuacgaaugucccaugcuggacgaaggaguagagcccgacgacguagacugcuggugcaacacaaccagcacuuggguagucuacggaacgugucaucacaagaaaggcgaagcacgacgaucccgaagggcuguaacgcugccaucacacucgacccgaaaacuucaaacacgaucgcaaacauggcuagagucccgcgaauacacaaaacaccucauacgcgucgaaaacuggauauuccgcaaccccggcuucgcccuggccgcagccgccaucgcauggcuccucggcagcaguaccucccaaaaagucaucuaccucguaaugauccuacuaaucgccccagcauacagcauacgaugcaucggaguaucaaaccgcgacuucgucgaaggcaugagcggcggaacauggguagacguaguauuagaacacggaggcugcguaacuguaauggcgcaagacaaaccgacaguagacaucgagcuagucaccaccaccgucaguaacauggcagaaguccggucauacugcuacgaagccagcauaucagacauggcguccgacagccggugccccacccagggcgaagccuaccuagacaaacaauccgacacccaauacgugugcaaaagaacccuaguagacagaggauggggcaacggaugcggccuauucgggaaagggucgcucguaacaugcgcaaaauucgccugcucaaagaaaaugacagggaaaucaauccaaccagaaaaccuagaauacagaaucaugcuaucuguccacggcucccagcacagcggcaugauagucaacgacacaggccacgaaaccgacgaaaacagggccaaaguagaaaucacaccaaacuccccacgcgccgaagcaacauuaggcggcuucggcagccuaggccucgacugcgagccccgaacgggccuugacuucuccgaccuauacuaccucaccaugaacaacaaacacuggcuuguacacaaagagugguuccacgacauaccccuacccuggcacgcaggcgccgacacaggcacaccccacuggaacaacaaagaagcccuggucgaguucaaagacgcacacgcaaaacgccaaacaguaguuguacucggaagccaggaaggcgcuguacacacagcccucgcaggagcucuggaagccgaaauggacggugcaaaaggccgacucucaagcggccaccugaaaugcagacuaaaaauggacaaacucagacucaaaggggugagcuacagccucugcacagccgcauucacauucacaaaaauaccagccgaaacccuucacgguacagucacaguggagguccaauacgcaggaacggacggaccaugcaaagugcccgcccaaauggcagucgacaugcaaacccucacgcccguagggaggcucauaacagcuaaccccguaauaacagagagcacggaaaacagcaaaaugaugcucgagcucgacccgcccuuuggggacagcuacauagucaucggcguaggagaaaagaaaaucacacaucacuggcaccgaagcggcucaacaauaggcaaagcguucgaagcaacaguacgaggcgccaaaagaauggcugugcucggagacaccgccugggacuucgguuccguaggcggagcacucaacucucugggcaaaggcauacaccaaaucuucggagcagccuucaaaucccucuucggaggaaugucaugguucagccaaauccucauaggaacacugcucauguggcucggacuaaacaccaaaaacggcagcauaucccuaaugugccuggcacuaggaggcguccuaauauuccucucuaccgugguaucagcc

SEQ ID NO: 2927 - RNA, 2061 nt, Artificial Sequence
  KX811222.1 prME-short CDS opt
accagcguaggcaucgucgggcuacuacuaacaaccgcgauggccgccgaagucacacgcagaggguccgccuauuacauguaccuagacaggaacgacgccggcgaagcaauaucauucccgaccacgcuggggaugaacaaaugcuacauacagauaauggaccucgggcacaugugcgacgcaacaaugaguuacgaaugccccaugcuggacgaaggcguagaaccggacgacgucgacugcuggugcaacacaacgagugcauggguggucuacggaaccugccaccacaagaaaggcgaagcgcgcagaagccgccgagcagucacacuaccaagccacaguacacguaagcuccaaacaagaccacaaacauggcucgagucccgagaguacacaaaacacuuaauacgaguagagaacuggaucuucagaaacccaggauucgcacucgcagccgcagcaaucgcauggcuacuggguuccagcaccagccaaaaagucaucuaccucguaaugauacuccuaaucgccccggccuacuccaucaggugcaucggaguaagcaaccgcgauuucgucgaagggaugucgggaggaaccuggguagacgucguacucgaacacggcggcugugucacgguaauggcccaagacaaaccaacuguagacaucgagcuaguaaccacgaccguaucaaacauggccgaagucagaagcuacugcuacgaagcaucaaucagcgacauggccuccgacagcagaugccccacccaaggcgaagccuaccuggacaaacaaagcgacacacaauacguaugcaagagaacacuggucgaccgaggauggggcaacggcugcggccucuucgguaaagggucgcuaguuacaugcgccaaauucgcgugcagcaagaaaaugaccggaaaaagcauccaaccagaaaaccucgaauacagaaucaugcuauccguacacggcagccagcacagcggcaugauaguaaacgacaccgggcacgaaacagacgaaaacagggcaaaagucgagauaacacccaacucuccacgagccgaagcaacccucggaggauucgggagccucggacuagacugugaaccgaggaccggccuagacuucagcgaccuguacuacuuaacaaugaauaacaaacacuggcuuguacacaaagagugguuccacgacaucccccuaccauggcacgccggcgcagacaccggaacgccgcacuggaacaauaaagaggcccuaguagaguucaaagacgcccacgcaaaacgacaaacuguagucguccuaggcucacaagagggagcaguccauaccgcccuagccggagcgcucgaagcagagauggacggagcgaaagggcgccuaucaagcggacaccuaaagugcaggcuaaaaauggauaaacugcgccucaagggcgucagcuacucacucugcacagcagcauucacauucacaaaaaucccggccgaaacccuacacggaaccguaacaguagaaguacaguacgcaggaaccgacggacccugcaaagucccggcccaaauggcgguugacaugcaaacccuaacgcccguaggacgccugaucacagccaaccccguaaucacagaaucaaccgaaaauucaaagaugaugcuggaacuggacccgccauucggagacagcuacaucguaauaggggucggcgaaaagaaaauaacacaccacuggcaccgauccggaagcaccauuggaaaagcauucgaggccacagucaggggagcgaaacgaauggcaguccucggggauacagcaugggacuucggauccguaggcggagcccugaacucacugggcaaaggaauccaccaaauauucggagcagcguucaaaucacuauucggaggcaugagcugguucucacaaauacuaauaggcacacuacuaauguggcucggccuaaacacgaaaaacggcagcaucucccuaaugugccuggcccuaggaggcguacuaauauuccuaucaacagccguuuccgcc

SEQ ID NO: 2928 - RNA, 2061 nt, Artificial Sequence
  KX447516.1 prME-short CDS opt
acaucagucggaaucgucggccucuugcuuacaacagccauggccgcggagguaacacgccggggcagcgccuacuacauguaccuagacagaaacgacgccggcgaagcaaucagcuuccccaccacacucgguaugaacaaaugcuacauccaaaucauggaccucggccacaugugcgacgccaccauguccuacgaaugccccaugcuagacgaaggcgucgaacccgacgacguagacugcuggugcaacaccaccagcacauggguggucuacggaaccugccaccacaagaaaggagaagcccgaaggagccgccgcgcagucacccuacccagccacucaacaagaaaacugcagacacgaagccaaacauggcuagaaucccgcgaauacacaaaacaccuaaucagagucgaaaacuggaucuucagaaauccaggcuucgcacucgccgcugcagcaauagcguggcuacucggcagcucaacaucaaagaaaguaaucuaccuaguaaugauccuacugauagcaccagccuacagcaucagaugcaucgggguauccaacagagacuucgucgaaggcaugagcggagggacguggguagacgucguccucgaacacggcggaugcgucaccguaauggcacaagacaaaccaacagucgacauagaacucguaaccacaaccgucucgaacauggccgaaguccgaagcuacugcuacgaagcgagcaucagcgacauggcaucagacucacggugcccaacccaaggagaagcauaccuagacaaacagagcgacacccaauacgucuguaaaagaacccucgucgaccgcggauggggcaacggcugcggccuauucggaaaaggaucacucguaaccugcgccaaauucgccugcuccaagaaaaugacaggaaaaaguauucagcccgaaaaccuugaguaccgcaucaugcugucgguccacggaagucaacacagcggcaugaucguaaacgacacuggacacgagaccgacgaaaaucgagcaaaagucgaaauaacaccgaacucaccccgcgccgaagccacccuuggcggauucggaucccucggccuagacugcgaacccagaaccggccuagacuucucggaccucuauuaucucacgaugaacaacaaacacuggcuuguccacaaagaaugguuccacgacauuccacuacccuggcacgcaggagcagacaccggcaccccacacuggaacaacaaagaagcccuaguggaguucaaagacgcccacgccaaacgccagacaguaguaguccuaggcucccaagaaggagccguccacacagcccuggccggcgcacuagaagccgaaauggacggggcgaaagggcgccuuaguagcgggcaucuuaaaugccgccuaaaaauggacaaacucagacucaaaggagucagcuauucccucugcacugcagcauucaccuucacuaaaaucccagccgaaacccuacacggcaccguaaccguggaaguacaauacgcgggcacagacggcccaugcaaaguacccgcccaaauggccguagacaugcaaacccucacaccagugggcaggcucauaacagccaaccccgucaucacggaaucgaccgagaacaguaaaaugaugcuggaauuagacccgcccuucggagauagcuacaucguaaucggaguaggagagaagaaaaucacacaccacuggcaccgaucaggcagcacaaucggcaaggcuuucgaggccaccguaagaggcgcgaaacgcauggcaguacuaggcgacacagccugggacuucggcucaguuggaggcgcccuaaacagccuaggcaaaggcauccaccaaaucuucggcgccgcauuuaaaagccuauucggcggaauguccugguucagccagauccugaucggaacucuccuaauguggcugggguuaaacaccaaaaacgggucgaucucacuaaugugccucgcacuaggcggaguacuaaucuuccugagcacagcagucagcgca

SEQ ID NO: 2929 - RNA, 2061 nt, Artificial Sequence
  KX520666.1 prME-short CDS opt
acauccgucgggaucgucggccuccuacugacaaccgcuauggccgccgaagucacacgcagaggauccgcuuauuacauguaccucgaccgaaacgacgcaggcgaagcgaucaguuuccccacaacccucggaaugaacaaaugcuacauacaaaucauggaccucggacacaugugcgaugcgacgauguccuacgaaugccccauguuagacgaaggcgucgaacccgacgauguagacugcuggugcaacacaaccagcaccuggguaguauacggcacaugccaccacaagaaaggagaggcccgcagaucacgcagagcagucacacuacccagucacagcacgagaaaacuccaaacaaggagccagacauggcucgagagccgggaauacacaaaacaccuaauacgaguagaaaacuggaucuuccgaaacccaggauucgcgcucgccgccgccgccaucgccuggcuccucggcagcagcaccagacagaaaguaauauaccucgucaugauccuccuaauagcaccagcauauucaauacgaugcaucgggguaagcaaccgcgacuucguugaagggauguccggcggaacauggguagaugucguccuugaacacggcggcugcguaaccguaauggcccaagacaaacccacgguagacauagagcucguuacaacaaccguauccaacauggccgaagucaggagcuacugcuacgaggccagcauauccgacauggccagcgacagcagaugucccacacaaggagaagcguaccucgacaaacaaagcgacacacaauacguaugcaaacgaacccuagucgacagaggcuggggaaacggaugcggccucuucggcaagggcucccucguaaccugugcaaaguucgccugcuccaagaagaugaccggcaaaagcauacaacccgaaaaccuagaauaucgaaucaugcuaagcguacacgggagccaacacucaggcaugaucgucaaugacacaggccacgaaacagacgaaaacagggccaagguagaaaucacccccaacagcccccgcgccgaagccacccugggcggauucggcagccuaggccuagacugcgaacccagaacaggacuagacuucuccgaccucuacuaccucacaaugaacaauaaacauuggcugguacacaaggaaugguuccacgacauaccccucccuuggcacgccggagcagacaccggaacuccacacuggaacaacaaagaagcccuaguggaguucaaggacgcacacgcaaagagacaaacggucguaguacugggaucacaagaaggcgcaguccacaccgcccucgcgggagcacuagaagccgaaauggacggcgcaaaaggccgacuauccagcgggcaccuaaaaugcagacuaaaaauggacaaacuccgacuaaaaggagucaguuacagccuaugcaccgccgcauucacguucacaaaaaucccggccgagacgcugcacggcaccgucacgguugaagugcaauacgccggcacagacggccccugcaagguucccgcccaaauggccguagacaugcaaacgcuaaccccagucggccgccuuauaacggccaaccccguaaucaccgaaucaacagaaaacuccaaaaugaugcucgaacuagacccaccauucggcgacagcuacaucguaaucggcgucggcgaaaagaaaauaacgcaccacuggcaucgcagcggaagcacaaucggcaaagcguucgaagccaccguacgcggagccaaacgcauggccgugcucggcgacacagccugggacuucggaucagucggcggagcccuaaacagccucggcaaaggcauacaccaaauauuuggagcggccuucaaaucccuauucggagggaugagcugguucucccaaauccugaucggaacccuccucauguggcucggacucaacacgaaaaacggcagcauaagccuaaugugccuggccuugggcgguguacucauauuucuaagcaccgccgucagcgcc

SEQ ID NO: 2930 - RNA, 2061 nt, Artificial Sequence
  KU497555.1 prME-short CDS opt
accaguguagggauaguaggccuacuccucacaacggccauggcagcagaagucacccguagaggaagcgccuauuacauguaccuagaccgaaacgaugcgggcgaggccaucagcuucccaaccacucuaggcaugaauaaaugcuacauacaaaucauggaccucggacauaugugcgacgcgacaaugaguuacgaaugccccaugcuagacgagggcguagaaccagacgacguggacugcuggugcaauacaaccuccacaugggucgucuacggaacaugccaccacaagaaaggcgaggcccgacgcucgcgccgcgcuguaacauuacccucgcacuccacccgaaaacuccaaacacggagccaaacguggcucgaaagcagagaauacacaaaacacuuaauaagaguagaaaacuggauauuucgaaaccccggcuucgcccuagccgcggcagcgaucgcauggcuccuuggaagcagcacaagccagaaagucauauaccuagugaugauccuccucaucgcgcccgcauacucaauccggugcauaggcgucagcaacagagacuucguagaaggaaugagcggcggcaccugggucgacguagugcucgagcacggcggaugcgucaccguaauggcacaggacaaaccaaccgucgacaucgaacucgucacaaccacggucucaaacauggccgaagucagaucguacugcuacgaggccuccaucagcgacauggccagugacuccagaugccccacgcaaggggaagccuaccucgacaaacaaucagacacacaauacguaugcaaacgaacacucgucgacaggggauggggaaacggcugcggccucuucgguaaaggaucgcugguaaccugcgccaaauucgccugcagcaagaaaaugaccgggaaaagcauccaaccugaaaaccuagaauaccgcauaaugcucucaguccacgggucccagcacagcggcaugauagucaacgacacaggccacgaaaccgacgaaaacagggccaaaguagaaaucacccccaacagcccacgcgccgaagcaacgcuaggcggcuuuggaucccucggacuagacugugaaccacgaaccggccucgacuucuccgaccuauacuaucucaccaugaauaacaagcacuggcucgugcacaaagaaugguuccacgacaucccacucccauggcacgccggcgccgacaccggaacgccacauuggaacaacaaagaagcccuaguggaguucaaagacgcacacgcaaaaaggcaaacagucgucguacucggaacucaagaaggagcaguccacacagcgcucgcaggagcacucgaagcagaaauggacggggcaaagggcagacuauccagcggacaccucaagugccggcucaagauggacaaacuacgccuaaaaggcguaagcuacagccuaugcaccgcagccuucaccuucaccaagauacccgcagaaacccuacacggcacagucacaguggaaguccaauacgccggcaccgacggacccugcaaaguccccgcccaaauggcagucgacaugcagacgcucacacccguaggacguuuaaucacagcgaaccccguaauaaccgagucaaccgaaaacagcaaaaugaugcuagaacucgacccaccauucggcgacaguuacauagucaucggcguaggcgagaaaaagauaacccaccacuggcaccgaagcgggagcacaauaggcaaagccuucgaagcaaccguccgaggagccaaaagaauggccguccuaggagacaccgccugggauuucgggagcgucggcggggcacucaacagccucggaaaaggcauacaccaaauauucggggcagcauucaagagcuuguuuggagggaugucaugguucucccagauccucaucggcacccuacucauguggcuaggacuaaacaccaaaaacgggucgaucucacucaugugccuagcccucgggggcguacuuaucuuccuaucaacagcaguaagcgca

SEQ ID NO: 2931 - RNA, 2061 nt, Artificial Sequence
  KY075939.1 prME-short CDS opt
acgagcgucggcaucguaggacuacuccucacuaccgccauggcagccgaagucacaagacgaggauccgccuacuacauguaccuagaccgcaacgacgcaggcgaagcaauauccuucccaaccacgcuggguaugaacaaaugcuacauacaaauaauggaccucggacacaugugcgacgcaacaaugucguacgaaugcccgaugcuagacgaaggaguagagccagacgacgucgacugcuggugcaacacaaccuccacgugggucguguacggcacaugccaccacaaaaagggagaggcccgaagaagccgacgagccguaacccuccccucacacucgacccgcaaacuucagacacgcagccaaacauggcuagaaagcagagaauacaccaagcaccugaucaggguagaaaauuggauauuccgcaaccccggauuugcccuagcagccgcagccaucgcauggcuccugggauccagcacaucacagaaaguaauauaccuuguaaugauccuacuaaucgcaccagccuacucccuccggugcauaggcgucagcaaccgcgacuucgucgaaggcaugucaggcgggaccuggguagacguaguacucgaacaugggggaugcgucaccguaauggcacaggacaaaccaaccgucgacaucgagcugguaaccacaacaguaagcaacauggcagaagugcgcucauacugcuacgaagcauccaucagcgacauggccagcgacucccgcugcccaacacaaggcgaagccuaccuagacaaacaaagcgacacccaauacgucugcaagagaacccucguagaccgaggcugggguaacggcugcggacucuucggcaaaggcucacucgugacuugcgccaaguucgcaugcagcaagaaaaugacaggcaaaagcauacaaccagaaaaccuagaauacagaaucaugcucagcguucacggaucccaacacuccgggaugaucgucaacgacacaggccacgaaacagacgaaaaccgcgcaaaagucgaaaucacaccaaacagcccacgcgcagaagcaacacuuggcggauucggcagccucgggcuagacugcgaaccccgaacgggccuggacuucagcgaccuauacuaccuaaccaugaacaacaaacacuggcuaguccacaaagaaugguuccacgacaucccccucccauggcacgccggagccgacacaggaacaccccacuggaacaauaaagaagcccuaguagaguucaaagacgcccacgccaaacgccaaacaguaguaguucuagggagccaagaaggagcaguccacacagcgcucgcaggcgcccuggaggcagaaauggacggagccaaaggacggcucuccagcggacaccuuaagugccggcuaaaaauggacaaacucagacucaaaggcguaucuuacaguuuauguaccgccgccuuuacauucaccaagauccccgcugaaacacuucacgggaccgucacagucgaaguccaauacgcggguaccgacggaccaugcaagguccccgcgcaaauggcaguagacaugcagacauuaacacccguaggccggcuuaucacagcaaacccaguaaucacagaaucaacagaaaacucaaaaaugaugcucgagcuagacccgcccuucggggacucauacaucgucaucggagucggagagaaaaagaucacacaccacuggcaccgcagcggcagcacgaucggaaaagcguucgaagccacugugcgcggagcgaaaagaauggcaguacugggagacacugcgugggacuucggcucagucggaggggcacuaaacagccugggcaaaggaauacaccaaauauucggcgcggcauucaaaucccucuucggaggaaugaguugguucucacaaauccugaucggcacccuacucauguggcugggucucaacaccaaaaacgggucaauaagccucaugugccucgcacuaggcggaguacuaaucuuccucaguacagcaguaagcgcc

SEQ ID NO: 2932 - RNA, 2061 nt, Artificial Sequence
  KY075932.1 prME-short CDS opt
accuccgucgggauaguaggccuacuacucaccaccgcuauggcagcagaaguaacccgaaggggcagcgcauauuacauguaccuagacagaaacgacgccggcgaagcgaucaguuucccgacaacgcugggaaugaacaaaugcuacauacaaaucauggaccucggacacaugugugacgccaccaugucauacgaaugcccgaugcucgacgagggagucgaacccgaugauguagacugcuggugcaacacaacaagcacuugggucgucuacgggaccugccaccacaagaaaggcgaagcacgucgcagccgcagagcuguaacccucccaucgcacagcacacgcaaacuccaaacccgcucccaaacguggcuggaaucccgcgaguacaccaaacacuuaaucagaaucgaaaauuggaucuuccgcaaccccggcuucgcacucgcggcagccgccauagcguggcuccuaggcucauccacgagucaaaaaguaauauaccucgucaugauccuacuaauagcccccgccuacuccauacgcugcauaggcgucagcaaccgagacuucguagaaggaaugucuggaggcaccugggucgacguaguacuggaacacggcggcugcgucacggugauggcacaagacaaaccgaccguagacaucgaacucgucaccaccacaguaagcaacauggcugagguccgcucguacugcuacgaggcaagcauaagcgacauggcaucagacuccaggugccccacccaaggagaagccuaccucgacaaacaaagcgacacccaauauguaugcaaaaggacccuagucgaccgcggguggggaaacggcugcggacuauucggcaaaggaagccucguuaccugcgcaaaauucgcaugcuccaagaaaaugaccggcaaaucuauacaaccagaaaaccucgaauacagaauaaugcuaucaguccacggcucacaacacagcggcaugaucgucaaugacaccggccacgaaaccgacgaaaacagagcaaaaguagaaaucacccccaacagcccacgagccgaggccacccucggcggcuucggaucgcuggggcuagacugcgaacccagaacaggccucgacuucucugaccuauacuaccuaacgaugaacaacaaacacuggcucguccacaaagaaugguuccacgacaucccacuaccauggcacgcaggcgcagacacaggaacaccccacuggaauaauaaagaggcacuugucgaguucaaagacgcacacgccaaaagacaaaccgucguaguccucggcagccaagaaggugcuguacacaccgcacucgccggcgcccucgaagcagaaauggacggcgcaaaaggccgccuaucaucaggccaccuaaaaugccgccucaaaauggacaaacuccgacuaaaaggcgucagcuacucgcucugcaccgcggccuucaccuucaccaaaauccccgcagaaacccuacacggaaccgugaccgucgaaguccaauacgcaggaaccgacggaccaugcaaagucccagcacaaauggccgucgacaugcagacacuaacaccaguaggcagacucauaacugccaacccaguaaucacagaauccaccgaaaacaguaaaaugaugcucgaacuagacccgccauucggcgacagcuacaucgucaucggcgucggggaaaagaaaaucacacaucacuggcaccgcucaggauccacaaucggcaaagccuucgaagccacaguccgaggggcuaaaagaauggcaguccucggcgacaccgcaugggacuucggcagcguaggcggcgcccuaaacucacucggaaaaggcauucaccaaauauucggcgcagcauucaaaucacuuuucggaggaaugagcugguucucacaaauacuaaucggaacacuacuaauguggcucggacucaacaccaaaaacggguccauaagccugaugugucuagcccuaggaggaguacucaucuuccuaagcaccgcagucuccgca

SEQ ID NO: 2933 - RNA, 2061 nt, Artificial Sequence
  KU870645.1 prME-short CDS opt
acaucagugggaauaguaggacuccuacuaacgaccgcaauggccgcagaaguuacccgaagaggcagcgcauacuauauguaccucgaccgcaacgacgccggcgaagccaucucauucccaaccacacucgggaugaacaaaugcuacauccaaauaauggaccuaggacacaugugcgacgcgaccaugucauacgagugucccaugcuugacgaaggcguagaaccggacgacguagacugcuggugcaacaccacgagcaccugggugguauacggcaccugccaccacaaaaaaggcgaggcgagaaggagcagacgagccgucacccuucccagccauucaacccgaaaacuacaaacaagaagucaaacguggcuagaaucacgcgaauacacaaaacaccugauccgcguagaaaacuggauccuaaggaacccaggauucgcacuggccgccgcggccaucgccuggcuccuagggagcagcacaucccaaaaaguaaucuaccuagucaugauccuccugauagcgcccgcguacagcaucagauguaucggcgucuccaaccgagacuucguagaaggaaugucuggggguacaugggucgacgucguccuagaacacggcggcugcgucacaguaauggcacaagacaaaccaacgguagacauagaacucgugaccaccaccgucucaaacauggcagaaguacgaucguacugcuacgaggcguccauaucagacauggccagcgacagccgcugcccaacccagggagaggcauaccucgacaaacaauccgacacccaauacgugugcaaaaggacacuagucgaccgggggugggggaacggcugcggccucuuuggaaaaggcagccucgucacaugcgccaaauucgccugcuccaaaaaaaugacagggaaaagcauccaaccagaaaaccuagaauaccgaaucaugcucuccgugcacggcucacaacacuccgggaugauaguaaacgacacaggacacgagaccgacgaaaaccgagccaaaguugaaauaacccccaacagccccagagcugaagccacacuuggaggauucggaucccuaggccucgacugcgaaccacgcacgggccucgacuuuagcgaccuauacuaccuaaccaugaacaacaaacacuggcugguccacaaagaaugguuccacgacaucccgcugccauggcacgccggcgccgacacgggaaccccccacuggaacaacaaagaggcacucgucgaauuuaaagacgcacacgccaaacgacaaaccgucguuguacuaggcucacaagagggcgcgguccauacagcacuagcaggcgcccuggaggccgaaauggacggagccaaaggccgacucuccagcggacaucuaaaaugccgacugaagauggauaaacuacgacucaaaggagucucauacucacuauguaccgcagcauuuacauucacaaaaauacccgcagaaacacuacacggaaccguaaccgucgaaguccaguacgccggcacggacggccccugcaaaguccccgcccaaauggccgucgacaugcaaacacugaccccagucggccgccucauaaccgcaaacccagucaucacugaauccaccgagaacagcaaaaugaugcucgagcucgacccccccuucggcgacagcuacaucgucaucggcaucggggaaaagaaaauaacacaccacuggcaccgauccggcagcaccaucggcaaagccuucgaggcaacaguccgcggagcaaaacgcauggcaguccucggagacaccgccugggacuucggcagcgucggaggagcccucaacucucugggcaaagggauacaccaaaucuucggagcagcauucaaaagccuauucggcggaaugagcugguucucccaaauacucauaggaacccuccucauguggcucggacuaaacaccaaaaacggauccauaagccuaaugugccuagcucucggaggcgugcuaauauucuuaaguaccgccgucagcgcc

SEQ ID NO: 2934 - RNA, 2061 nt, Artificial Sequence
  KU729217.2 prME-short CDS opt
accuccguaggaaucgucggccuccugcuaaccaccgccauggcagccgaagucacacgccgcggcucagcauacuacauguaucucgacagaaaugacgccggugaagccauaucauuccccaccacacugggcaugaauaagugcuacauccaaaucauggaccugggccacaugugcgacgccacaauguccuacgaaugucccaugcucgacgaaggcgucgagcccgacgacguagacugcuggugcaacaccacuagcacgugggucgucuacggaaccugccaccacaagaaaggcgaagcccgccgaucaagaagggcagucacccuucccucacacagcacccgaaaauuacaaacaagaagccaaacauggcucgaaagccgcgaauacacaaaacaccuuauccgcguagagaacuggaucuuccgcaaccccggcuucgcccucgccgccgccgccaucgccuggcuacuuggcucauccaccagccaaaaagucaucuaccuagucaugauccuacucaucgcacccgccuacuccauccgaugcaucggcguauccaaccgcgacuucgucgaaggaaugaguggcggcaccuggguagacguuguccucgaacacggcggaugcguaaccgucauggcccaagacaaaccgaccgucgacauagaacucgucucaaccaccguaagcaacauggcagaaguaagaucauacugcuacgaagcaaccauaagcgacauugcgucggacucccgcugcccaacucagggcgaagccuaccuagacaaacaaucagacacccaauacgugugcaaacgaacccucguggauagaggcuggggcaaugggugcgggcuuuucgggaaaggcucccuggucacaugcgccaaauucgccuguagcaagaaaaugacaggcaaauccauccaaccggaaaaccucgaauaccgcaucaugcuaucaguacacggcagccaacacagcggcaugauuguaaacgacacaggacacgaaaccgaugaaaaccgagccaaagucgaaauuacccccaacucaccccgcgccgaggcaacccuuggaggcuucggcucccucggacuggacugcgaaccaagaacaggccucgacuuuuccgaccucuacuaccuaaccaugaacaacaaacacuggcucguacacaaggaaugguuccacgacaucccccuucccuggcacgcgggagcggacaccggcaccccacacuggaacaacaaagaagcgcuggucgaguucaaagacgcccaugccaaacgccaaacagccgucgugcucgggagccaagaaggagcaguucacaccgcccuagccggcgcccuggaagcagaaauggacggcgccaaagggcgacucuccuccggccaccucaaaugccgacuaaagauggacaaauuacgccuaaaaggagucuccuauagccuaugcacagccgcauucacauucacaaagauacccgcagaaacccuccacggcaccguaaccgucgaaguacaauacgcaggaacggacggaccaugcaaaguacccgcccaaauggcagucgacaugcaaacccuaacccccgucggacgacucauaaccgccaacccagucaucacagaaagcaccgaaaacucaaaaaugaugcucgaacucgacccacccuucggcgacucauacaucgucaucggcgucggagaaaagaaaauaacccaccacuggcaccgcuccggcagcacgaucgggaaagcauucgaagccacaguccgaggagccaagcgaauggcaguccuaggcgauacagccugggacuucggcucaguagguggcgcccuaaacucacucggaaagggaauccaccaaauauuuggcgccgcauucaaaucccuauucggcggcauguccugguucagccagauauuaauaggaacacuacucauguggcuagggcucaauaccaaaaacggcuccaucucgcuaaugugccuagcccucgguggcguacucaucuuccucagcaccgcagucuccgcc

SEQ ID NO: 2935 - RNA, 2061 nt, Artificial Sequence
  KX087101.3 prME-short CDS opt
acaagcguuggaaucguaggacuacuacugaccaccgccauggcugccgaagucacacgccgaggcucagccuacuacauguaccucgaccgaaacgacgccggugaagcaauaucauucccaaccacacucggcaugaacaaaugcuacauccaaaucauggaccucggacacaugugcgacgccaccaugagcuacgaaugucccaugcuagaugagggcgucgaaccagacgaugucgacugcuggugcaacaccaccuccaccugggucguguacgguaccugccaccacaagaaaggcgaagcccgacgaucacgacgcgcagucacacucccaagccacagcaccaggaaacuccaaacacgcagccagacauggcucgaaagccgcgaauauacaaaacaccuaauaagaguagaaaacuggaucuuccgaaacccaggcuucgcccucgcagccgccgcgaucgcauggcuacucgggagcucaaccucccaaaaagucaucuaccuaguuaugauacuacuaauagcacccgcuuacuccauccgaugcauaggcgucucaaaccgcgacuucgucgaaggaaugagcggaggcaccuggguagacguaguccucgagcacggagguuguguaaccgucauggcucaagacaaaccaacggucgacauagagcuaguaacaacaaccgucucaaacauggcagaaguccggagcuacugcuacgaagccagcaucuccgacauggccucugauucccgcugcccaacacaaggcgaggcuuaccuagacaaacagucagacacccaguauguuugcaaacggacacucgucgaccgaggguggggcaacggaugcggccucuucggcaaaggcucccucguaacaugcgcaaaauucgcuuguucaaagaaaaugacaggcaaaucaauccaaccggagaaccucgaauaccgcaucaugcucagcguccacgggagccaacacuccggaaugauagucaacgacaccggacacgaaaccgacgaaaaccgagcaaaaguggaaaucacgccuaacagcccccgggccgaagcaacccuaggaggcuucgggucccuggggcuugacugcgaaccucguaccggccuagacuucagcgaccucuacuaccuaaccaugaacaacaaacauuggcuaguacacaaagagugguuccacgacauccccuuacccuggcacgccggagcagacaccggcacaccccacuggaacaacaaagaagcccucguugaguucaaagacgcacacgcaaaacgccaaaccguagugguucuaggaucccaagaaggagccguccacaccgcccucgccggagcacucgaagccgaaauggacggcgcaaaaggcaggcucagcagcggacaccucaaaugccgacuaaaaauggacaaacuccgacucaaaggcguguccuacucccugugcacagccgccuucaccuucaccaaaauccccgccgaaacacuccacggcacgguaacaguagaacuacaauacgccgggacagauggaccaugcaaaguccccgcacaaauggcaguagauaugcaaacacuaacccccguaggccgccuuaucaccgcaaaccccgucaucaccgaauccacagaaaacuccaaaaugaugcuugaacucgacccaccauucggcgauucauacaucgucauaggcgucggagaaaagaaaaucacgcaccacuggcacaggagcggcuccaccauaggcaaagcguuugaagccaccgugcgcggcgccaaacgaauggcaguccucggagacacagccugggacuucggcuccguuggcggggcacuaaacucacucggcaaaggcauccaccaaaucuuuggagccgcguucaaaucacucuucgguggcaugucuugguucucucagauccuaaucggcacucuucucauguggcuaggacucaauaccaaaaacggcucgaucagccucaugugccucgcacucggcggcguacucauuuuccucagcacagccgucucagcc

SEQ ID NO: 2936 - RNA, 2061 nt, Artificial Sequence
  KY014317.1 prME-short CDS opt
acauccguaggaaucgucggacuccugcucacaaccgccauggccgccgaagucacaagacgaggcuccgcauacuacauguaccucgaccgcaacgacgccggcgaggcaaucagcuucccaaccacccucggcaugaacaaaugcuacauacaaauaauggaucuaggacacaugugcgacgccacgaugagcuacgaaugccccaugcuggacgaaggaguggagccagacgacgucgacugcuggugcaacaccacaagcacauggguuguauacggaaccugccaccacaagaaaggcgaggcccgccgcagcagacgagcaguaacucuaccaucccacuccacacgcaaacuccaaacucgaucccagaccuggcucgaaagccgagaauacacaaaacaucucauacgcgucgaaaacuggauauucagaaacccaggguucgcacucgccgccgccgccaucgccuggcuccuaggcagcagcacaucccaaaaagucaucuaccuaguaaugaucuuauuaauagcccccgcguacuccauacggugcaucggaguaucaaaccgagacuucguagaaggaaugagcgggggcacgugggucgacguuguccucgaacacggcggcugcguaaccguaauggcccaagacaaaccaacaguagacauagaacucgucaccacaaccgucagcaacauggccgaagugcgcucauacugcuacgaagccuccauuuccgacauggccucugacaguaggugcccaacgcagggagaagcauaccuagacaaacaaagcgacacccaauacgucugcaagcgcacucuagucgaccgaggauggggaaacgggugcggucuauucggaaaaggcagucuuguaaccugcgcaaaauucgcuugcuccaagaaaaugacaggcaaaagcauacaacccgaaaaccucgaauaccgcaucaugcucuccguccacggcucacaacacucagggaugaucgucaaugacacaggccaugaaaccgacgaaaaccgggccaaagucgaaaucacccccaacagccccagagccgaagcaacccuaggaggcuucggcagccuaggccucgacugcgaaccucgcaccggucuggacuucuccgaucucuacuaccucaccaugaacaacaaacauuggcucguccacaaagaaugguuccacgacaucccccucccauggcacgccggagccgacacaggaacaccacauuggaacaacaaagaagcacuggucgaguucaaagaugcccaugccaagagacagaccgucgugguccucggcucacaagaaggcgccguacacaccgcacucgccggagcgcucgaagccgaaauggacggagccaaagguaggcuaagcuccggacaccugaaaugcagacuuaaaauggacaaguuacgccucaaaggcgucucauacucccuuugcacagccgcauucacuuucacaaaaauccccgccgaaaccuuacacgggacaguaacuguggaagugcaauacgccggcaccgacggaccgugcaagguccccgcgcaaauggcagucgacaugcaaacacuaacacccguaggccgccugaucacagcaaacccuguuaucacagaaucaauagaaaacuccaaaaugaugcuugaacucgacccaccguucggagacagcuacaucguaauaggcgucggcgaaaagaaaauuacccaccacuggcaccgcucaggcagcacaaucggaaaagccuucgaagccacaguccggggcgccaaacgaauggccguccucggcgacaccgcaugggacuucggaucaguaggaggcgcacucaacagucuugggaaaggaauccaccaaauauucggagccgccuucaagagccucuucggaggcauguccugguuuagccaaauacuaauaggcacacuccuaauguggcuaggccucaacaccaagaacggcagcaucagccucaugugccucgcccucggaggaguacuaauauuccuauccaccgccgucagcgcc

SEQ ID NO: 2937 - RNA, 2061 nt, Artificial Sequence
  KU758876.1 prME-short CDS opt
acaaguguaggaaucgugggucuccuccugacaaccgcaauggccgcagaaguaacacggcggggguccgcauacuacauguaccucgaccggaacgacgcaggcgaggccaucucuuuccccaccacccuaggcaugaacaaaugcuacauccaaauaauggaccuaggacacaugugcgacgcaaccauguccuacgaaugccccaugcuagaugaaggagucgaaccagacgacguggacugcuggugcaacaccaccaguaccugggucgucuacggaacaugccaccacaagaaaggggaggcucgcagaagccgccgagcugucacacucccaagccacagcaccagaaaacuccaaacacgaucccaaacauggcuagaaucgcgcgaguacaccaaacaccucauccgcguggaaaacuggaucuuccgaaacccaggcuucgcccucgcagcggcagcaauagcauggcuguuaggauccuccacaagccaaaaaguaauauaccugguaaugauccuacucaucgcacccgcauacuccauccgaugcauaggaguauccaaccgggacuucgucgaaggaaugagcggaggaaccugggucgacgugguccuagaacacggcggaugcgucaccgucauggcacaagacaaacccacaguggacaucgagcuaguaaccaccaccgugucaaacauggcugaaguuagauccuacugcuacgaagcaagcaucagcgacauggcgagugacagcagaugccccacacaaggcgaagcauaccucgacaaacaauccgauacccaauacguaugcaaacgcacacucguagaccgcgguuggggcaacggcugcggauuauucgggaaagggagccucguuaccugcgcaaaauucgccugcagcaaaaagaugacaggcaaaagcauccaacccgagaaucuagaauacagaauaaugcucuccguacacggaucccaacacucagggaugauaguuaaugacacaggccacgaaacagacgaaaaccgagccaaaguugaaauaaccccgaacucaccaagagccgaagccacccuaggaggcuucggaucucucggacucgacugcgaaccccgcacaggacuagacuucuccgaccuauacuaucucacuaugaacaacaagcacuggcucguacauaaagaaugguuccacgacaucccacuacccuggcacgcgggcgcagacacagggacgccccacuggaacaauaaagaagcgcucguagaguucaaggaugcucacgccaagcgccaaacagucguaguacuaggcucccaagaaggcgccguccacacagcccuagcaggagcccuggaagccgaaauggacggaguaaagggcagacucucuagcgggcaccuuaaaugccgacugaaaauggacaaacucagguuaaagggcguauccuauucacugugcaccgcggcauucacauucaccaaaaucccggccgaaacacuccacggcacaguaacggucgaaguccaauacgccggcacggacggacccugcaaaguacccgcccaaauggcagucgacaugcaaacccucacacccgucggaaggcuaauaacagccaaccccgucaucaccgaaagcaccgaaaacagcaaaaugaugcucgaacuagacccacccuucggcgacucauacauagugaucggcgucggcgaaaagaaaaucacgcaccacuggcacagaucaggaucgacaauaggaaaagccuucgaagcgacaguccgcggagcaaaacgaauggccguauuaggggacacagcaugggacuucggcuccgucggcggcgcacucaacucccucgguaaaggaauacaccaaauauucggugcagcuuucaaaucacuauucggcggcauguccugguucagccaaauucucaucggaacacuccucauguggcucggccuuaacacuaaaaauggcucaaucucguucaugugccucgcccuaggcggaguccugaucuuccucuccaccgcgguauccgcc

SEQ ID NO: 2938 - RNA, 2061 nt, Artificial Sequence
  KU758874.1 prME-short CDS opt
acaagcguaggaauagucggacuacuacucacaacggcaauggcagccgaagucacccgaagagggagcgccuauuacauguaccuagacagaaacgacgcaggagaagcaaucucauuccccacgacacucgggaugaacaaaugcuacauacaaauaauggaccuaggacauaugugcgacgcgacaaugucauacgaaugcccaaugcucgacgaaggaguggaacccgacgacguagacugcuggugcaacaccacauccaccugggugguauauggcacaugccaccacaagaaaggcgaagcacgccgaagccgccgagcagucacacucccaagccacagcacccgcaaacuccagacaagaagccaaacauggcuagaaucccgagaauacacuaaacaccuaauacggguagaaaacuggauauucagaaacccaggauucgcacuugcagccgcagccaucgcuuggcuccuaggaagcuccacgucccaaaaagugaucuaucucgucaugauacuacugaucgcccccgccuacagcauacgcugcauaggcguaagcaaccgagauuucguggaaggaaugagcggcggcaccuggguagacgucguucuagaacacggaggcugcguaaccguaauggcccaagacaaacccaccguggacaucgaacugguuacaaccaccguauccaacauggccgagguuagaagcuacugcuacgaagcguccaucucagacauggccucagacucacgcugccccacacaaggagaagcauaccucgacaaacaaucagauacgcaguacgucugcaaaagaacacugguggaccgcggcuggggaaacggaugcggccuguucgguaaaggcagccucgucacaugcgcaaaauucgcgugcucgaaaaagaugacaggcaaaagcauacaacccgaaaaccuagaauaccgaaucaugcuauccguccacggcucacaacacucuggaaugaucgucaacgacacgggccaugaaacggacgaaaacagagccaaagucgagauaacacccaacagccccagggccgaagcgacacucggaggcuucgguagccugggacuagacugcgaaccgcgcacaggccuggacuucagcgaccuuuacuaccugaccaugaauaacaaacacuggcucguccacaaggaaugguuccacgacaucccccugccauggcaugccggcgcagacaccggcaccccacacuggaacaacaaagaagcccuaguagaguucaaagacgcacacgcaaaacgccagacaguaguaguccugggcucacaggaaggcgcagugcacaccgcacuggcaggcgcgcuggaagccgagauggacggcgccaaagguaaacuaucuucgggccaccucaaaugccgucuaaaaauggacaaacuaagacuaaaaggggucuccuacagccucugcaccgcagccuucaccuuuacaaaaauaccagcagaaacacuccacgggacaguaaccgucgaagugcaguacgccggcacagacggccccugcaagguccccgcacagauggcagucgacaugcagacacucaccccaguaggacgccucauaaccgcaaaccccgucaucaccgaaagcaccgagaacaguaaaaugaugcucgaauuggacccaccauucggagacagcuacaucguaauaggaguuggcgaaaagaaaaucacacaccauuggcacagaagcgggagcaccauaggcaaagcauucgaagccacgguccgaggcgcaaaacggauggcagugcuaggcgacaccgcaugggacuuuggaagcgugggcggagcacugaacagucuaggaaaaggcauacaccagauauucggagcagcguucaaaagccuguuuggcggaaugucaugguucucgcaaauccucauaggcacccuacuuauguggcuagggcucaacaccaaaaauggaagcaucagccuaaugugccuagcacuagggggcguccuaauauuccucagcaccgccguaagcgca

SEQ ID NO: 2939 - RNA, 2061 nt, Artificial Sequence
  KY317939.1 prME-short CDS opt
acgagcgucggaaucgucggacuccuccuaaccaccgcaauggcggccgaagucacccgccgaggcagcgcauacuacauguaccuagaccgaaaagacgccggagaagcgaucagcuuccccaccacacuaggaaugaacaaauguuacauacaaaucauggaucugggacacaugugcgacgccaccaugagcuacgaaugccccaugcucgacgaaggcguagaaccggacgacguagacugcuggugcaacaccaccagcaccugggucguauacggaaccugccaccacaagaaaggagaagcacggcgaagccgacgcgccgucacacuccccucacacagcacccgcaaacuccaaacccgaucccaaaccuggcucgagagcagagaauacacgaaacacuuaauacgaguagagaacuggauauuccgcaaccccggauucgcacuagcagcagccgccaucgccuggcuacucggcucauccacaucacaaaaagucaucuaccuggucaugauacuacuaauagcacccgccuacagcauacgcugcauaggaguaagcaaccgcgacuucgucgaaggaauguccggcggcaccuggguagacguaguccuggagcacggcggcugugucaccguaauggcacaagacaaacccaccguagacaucgagcuaguaacaaccaccgucaguaacauggcagaaguacgauccuacugcuacgaagcaagcaucuccgacauggcgucagacucccggugucccacgcaaggagaagcauaccucgacaagcaaagcgacacacaauacgucugcaaacgaacccucgucgaccgaggauggggcaacgguugcggccuguucggaaaaggaucccucgugaccugcgcaaaauucgcaugcagcaagaaaaugaccggcaagagcauccaacccgaaaaccuagaauaccgcaucaugcugucaguccacggcagccaacacagcgggaugauagucaacgacacuggccacgaaaccgacgaaaacagagcaaaaguggagauaaccccaaacagcccccgagccgaggcaacacucggaggauucgggagccucggccucgacugcgaacccaggaccggacucgacuucagcgaccucuacuaccugaccaugaacaacaaacacuggcucguccacaaagaaugguuccacgacauaccucugccuuggcacgcaggcgccgacacgggaacuccacacuggaacaacaaagaagcccucguagaguucaaggacgcccacgcgaaaaggcaaacgguaguuguacuaggcagucaagaaggcgcaguacacaccgcccuagccggcgcccuagaagccgaaauggacggcgccaaaggccgucuauccagcggacacuuaaagugccgacuaaaaauggacaaacuucgccucaaaggggucucauacagucucugcaccgcugcguuuaccuucaccaaaauccccgcagaaacacuccacggaacugucacagucgaagugcaauacgccgggacagacggccccugcaaaguaccagcacagauggccgucgacaugcagaccuuaacaccugucggaagacucaucacagccaaccccgucauaaccgaauccacagaaaacagcaaaaugauguuagaacucgacccucccuucggagacucauacauaguaaucggcgugggcgaaaagaaaaucacccaccacuggcacagauccggauccaccaucggaaaagccuucgaagccaccguccgaggcgccaaacgcauggccguauugggagacacagcaugggacuucggguccguaggaggcgccuuaaacucgcuagggaaaggcauccaccaaaucuucggagccgccuucaaaagccucuucgguggcaugagcugguucucccaaauccucaucggcacgcuccuaauguggcuaggucugaacaccaagaacggcucaauaucccuaaugugccucgcacuaggcggaguccuaauauuccuaucaaccgccgucucagca

SEQ ID NO: 2940 - RNA, 2061 nt, Artificial Sequence
  KY014314.1 prME-short CDS opt
accuccgugggaaucguaggacugcuacucacaacagccauggcagcagaagucacccgaagaggcucugcguacuacauguaccuagaccgcaacgacgccggggaagcgauaucauucccaacaacacucggcaugaacaaaugcuacauccaaauaauggaccuaggccacaugugcgacgccacaaugagcuacgaaugcccaaugcucgacgaaggaguggagccagaugauguggacugcuggugcaacacgaccucaaccuggguaguauacggcacaugccaccacaaaaagggcgaggcccgcagaagccgcagagcagucacccuacccucacacucuacaagaaaacuacaaacacgcucccaaacauggcuagaaagcagagaauacacaaaacaccuaauacgaguagagaacuggaucuuccgaaacccaggcuucgcauuggcagccgccgcaaucgcuuggcuacuaggguccagcaccagccaaaaagucaucuaccuaguuaugauacuccucaucgccccagccuacagcauccgaugcauugguguaucaaacagggacuucguagaaggaaugagcggcggaacauggguagacgugguccucgaacacggcggcugcguaacgguaauggcccaagacaaacccacaguagauauagagcuagucacaacgacaguaagcaacauggccgaaguaagaagcuacugcuacgaagcaagcauaagcgacauggccucggacuccaggugccccacgcagggcgaagcauaccuagacaagcagagugacacccaauacgucugcaagcgcacgcuaguagacagaggauggggaaacgguugcggccuauucggaaaagggucacucgugaccugcgcaaaguucgccugcaguaaaaagaugacaggcaaaagcauacaacccgagaaccuggaauaccguaucaugcucagcguacacggcucacaacauagcgggaugauagucaacgacacaggccacgaaacggacgagaacagagcaaaagucgaaauaaccccaaacucaccccgagcagaagcaacccuaggcggcuucggaucccugggacuagacugcgaacccagaacaggccuugacuuuuccgaucuguauuaccugacaaugaacaacaagcacuggcuaguacacaaagaaugguuccacgacauaccccuacccuggcacgcaggcgccgacaccggcacaccccacuggaacaacaaagaagcccucguagaguucaaagaagcccacgcaaagcgccaaacgguagucguacuggggagccaagagggagccguacacacagcgcuagcgggagcacucgaagcagaaauggacggggccaaagggagacuuagcagcggccaccuaaaaugccgacuaaaaauggacaaacuccgccuaaagggaguaucauacucccugugcacagcagcauucaccuucaccaagauccccgcagaaacacuccauggcacagucacaguagaaguacaguacgccggcaccgacggacccugcaaaguaccagcacaaauggccguagacaugcaaacacuaaccccaguaggcagacucaucacagcuaauccaguaauaacagaaagcaccgagaacaguaaaaugaugcuggagcucgacccgcccuucggcgacuccuacaucguaauaggagugggcgagaaaaagauaacacaccauuggcacagaagcggcagcaccauaggcaaagcauucgaagcgacggugcgcggggcuaaacgcauggcagugcuaggcgacaccgcgugggacuucggcucaguaggaggggcacuaaacucacucggaaaaggcauacaccagaucuucggagcagccuuuaagagccucuucggaggcaugagcugguucucgcaaauacucaucggcacacuucucauguggcucgggcuaaacaccaaaaacggaucaaucagccucaugugccuagcacuaggagggguccucaucuuccuaagcacggcggucagugcc

SEQ ID NO: 2941 - RNA, 2061 nt, Artificial Sequence
  KX447517.1 prME-short CDS opt
accagcguuggaauagucggccuacuacuaaccacagcaauggccgccgaagucacacgcagaggguccgcuuacuacauguaccuagaccgaaacgacgcgggcgaagcaaucagcuuccccaccacccucggaaugaacaaaugcuacauccaaaucauggaccuaggacacaugugcgacgcgacuaugaguuacgaaugccccaugcucgacgaaggagucgaaccggacgacguagacugcuggugcaacaccacguccaccuggguaguauacggaaccugccaccacaagaaaggcgaagcacgccgaagccgccgcgccgucacgcugccaucucacucaacacgaaaacuacaaacacgaagucagacauggcuagagagccgcgaguacaccaaacaccugauaagaguugaaaauuggauauucagaaacccaggcuucgcgcuggcggcagcagccaucgccuggcuccucggaucauccaccagccagaaagucauauaccuaguaaugauccuccucaucgcaccagcguacagcauccgcugcaucggcguaagcaaccgcgauuucguagaaggcaugagcggaggcaccuggguagacguaguacucgaacacggaggaugcguaaccgucauggcccaagacaaacccacagucgacaucgaacucgucaccaccacaguaagcaacauggccgagguccgcagcuacugcuacgaggcaagcaucagcgacauggcaucggacucccgaugcccaacccaaggggaagcguaccuagauaaacaaagcgacacacaauacgucugcaaacgcacacuuguagaccgaggaugggguaacggaugcggacucuuuggcaaaggcagccucgucacaugcgccaaauucgcaugcucaaagaaaaugacaggaaaauccauccagcccgagaaccuggaguaccgcaucaugcucaguguccacgggagccaacacucaggcaugaucgucaacgacacgggccacgaaaccgacgaaaaccgagccaaagucgaaaucacccccaacucgccaagagcagaagccgcccucggcggcuucggaucacucggacuggacugcgaacccagaacuggacucgacuucucagaccucuacuaccucaccaugaacaacaaacacuggcucguccacaaagaaugguuccacgacauaccccuacccuggcacgccggugcugacacaggcacuccacacuggaacaacaaagaagcccuaguagaguucaaagacgcacacgcaaaacgccaaaccguagucguacuagggagccaagaaggcgccguacacaccgcacuagcaggcgcacuagaagcagaaauggacggcgcaaaaggcagacugucuagcggccacuuaaaaugccgucucaaaauggacaaacugagacucaaaggaguaagcuacucccuaugcacagcagcauucacauucacaaaaauacccgcagaaacacuacacggcacaguaaccgucgagguacaauacgcagggacagacgggcccugcaaagucccagcacaaauggccguggauaugcaaacccucacacccguaggacgacuaauaaccgcaaacccagucauuacagaauccaccgaaaacagcaaaaugaugcucgaacuagacccaccauucggcgacucauacaucgucauaggagucggggaaaagaaaaucacacaccacuggcaccgcagcgggucgaccaucggcaaagccuucgaagcgacaguuagaggggcaaaaaggauggccguccuaggcgacaccgcgugggacuucggcuccguaggcggagcccuaaacagucucggcaaaggaauacaccaaaucuucggagcagcguucaaaucacuauuuggcggcaugucuugguucucacaaacccuaaucgggacccuccucauguggcucggccuaaacaccaaaaacggcuccaucagccucaugugcuuagcccucggcgggguccuaauauuccuuuccacagcagucagcgcc

SEQ ID NO: 2942 - RNA, 2061 nt, Artificial Sequence
  KU926310.1 prME-short CDS opt
accagcguaggaaucgucggccuccuacuuaccaccgcaauggccgcagaagucacccgucgaggcucagccuacuacauguaccucgacagaaacgacgccggcgaagccaucagcuuuccgacaacgcuuggcaugaacaaaugcuacauacaaauaauggaccucggccacaugugcgacgcaacgaugucauaugaaugcccaaugcuagacgaaggcguagaaccagacgacgucgacugcugguguaacacaacauccaccuggguggucuacggaaccugccaccacaagaaaggagaagcucgacgaagccgacgcgccguaacacugcccagccauuccacgcgcaaacuccaaacacgcucccaaaccuggcuugagagccgagaguacacaaaacaccuaauacgcguggaaaacuggauauuccgaaaccccggcuucgcacucgccgcagccgcaauagcguggcuucuaggaagcuccaccucacagaaagugauauaucugguaaugauacugcucauagcacccgccuacagcauaagaugcaucggcgucucaaacagggacuucgucgaaggaaugagcggagggacgugggucgacgucguccuagaacacgggggcugcguaacagucauggcgcaagacaagcccacgguagacaucgaacuggucaccaccacagucucaaacauggccgaaguacgcuccuauugcuaugaagccucaaucucagacauggcguccgacagccgcugccccacccaaggcgaagccuaccucgacaaacaaucggacacccaauacgucugcaaaagaacacuuguagacaggggauggggcaacggaugcggacucuucggcaagggcagccuaguaacaugcgccaaauucgccugcucaaagaaaaugaccggaaaguccauccaacccgaaaaccuagaauacagaaucaugcuauccguacacggcagccaacacuccggcaugaucgucaacgacaccggccacgaaacagacgaaaaccgagccaaggucgaaauaacccccaacucacccagggcggaagcaacacuuggcggauucggcagccucggccuagacugcgaaccacgcaccggccuagacuucagcgaccucuacuaccuaacaaugaacaacaaacacuggcucguacauaaggagugguuccaugacauaccgcuacccuggcacgcaggcgccgacaccggaaccccacacuggaacaacaaagaagcgcucgucgaguucaaagacgcccacgccaaacgccagaccguagucguccuaggaucacaagaaggcgcuguacacacagcccucgccggagcccucgaagccgaaauggacggagcaaaaggccgccucagcagcgggcaccuaaaaugccgacuaaaaauggacaaacuccgucucaaaggaguaagcuacucccucugcacagccgcuuucaccuucacaaaaauaccagccgaaacccuccacggcaccgucacaguagaaguccaauacgcaggggcugacggacccugcaaaguccccgcccaaauggccguagacaugcaaacgcucaccccagucggcagacuuauaaccgcgaaccccguaaucaccgaaagcaccgaaaacucaaaaaugaugcucgagcuagacccacccuucggcgacagcuacaucgucaucggcgugggagaaaagaagaucacacaccacuggcacagaagcggcucgacaauaggcaaagcauucgaagccaccguacguggcgcgaaacgcauggccgugcucggagacaccgcuugggacuucgggagcguagggggagcccucaacucccucggcaagggaauacaccaaauauucggcgcugccuucaagagccucuucggcggaaugaguugguucucccaaauacucaucggaacucuccuaauguggcucggacucaacaccaaaaacggcucgauuucccucaugugccuugcacuuggcgguguccuuauauuucucuccaccgccguaucagca

SEQ ID NO: 2943 - RNA, 2061 nt, Artificial Sequence
  KU922923.1 prME-short CDS opt
accagcgucggcauuguaggccuauuacuuacaacagcuauggccgccgaagucacaagacggggauccgccuacuacauguaccuagaccgcaacgacgccggagaagccauaucauuccccacaacccuaggcaugaacaagugcuacauacaaauaauggaccuuggucacaugugcgacgccacaaugagcuacgaaugucccaugcucgacgaaggcguagagcccgacgacgucgacugcuggugcaacacaacauccacguggguaguauacgggaccugccaccacaagaaaggcgaggccagacggucacgacgagccguaacccuacccucccacuccacccgaaaacuccaaacacgcagccaaacuuggcuagaaucacgagaauacaccaaacaccuaauccgcguagagaacuggauauucagaaacccaggauucgcacuagccgccgccgcaauagccuggcuccuaggcucaucgaccucacagaaaguaaucuaccucguaaugauacuucucaucgcacucgccuacagcauccgcugcaucggcguaagcaaucgcgacuucgucgagggaaugucaggaggaacaugggucgacgucgugcuagagcacggcgggugcguaacggucauggcacaagacaaacccaccgucgacaucgaacucguaacgaccacagucucuaacauggccgaaguacgaaguuacugcuacgaagccuccauaucggacauggcaagcgacucccgcugcccgacccaaggagaagccuaccuggacaaacagagcgacacacaauacgugugcaaacgaacucuagucgaccgcggauggggcaacggaugcggccucuucggaaaaggaagccuaguaacaugcgcgaaauucgcuugcuccaagaaaaugaccgggaaauccauccaaccugagaaccuggaauaucgaauaaugcuauccguacacggcucccaacacuccggcaugaucgucaacgacacuggacaugaaacagacgaaaaccgcgccaaaguggaaaucacacccaacuccccacgcgcggaagcaacgcucggaggauucggcucacuaggccuagacugcgaacccagaaccggacuagacuucagcgaccucuacuaccucacaaugaacaacaaacacuggcuaguccacaaagaaugguuccacgacaucccccuaccauggcacgcaggggcggacacgggaacaccccacuggaacaacaaagaagcucucguagaguucaaagacgcgcaugcgaaacgacaaaccguaguaguccucggaucgcaagaaggagcaguacacaccgcccuggccggcgcccuagaagccgaaauggacggagcaaaaggccgacucagcagcgggcaccucaaaugcagacuaaaaauggacaaacuaagacucaaaggcguaagcuacagccuuugcacagcagccuuuacauucacaaaaauucccgcugaaacacuccacggcaccguaaccguagaaguccaauacgcaggcaccgacggaccaugcaaagucccagcacagauggcugucgacaugcaaacacucacacccguaggacgacuaauaacugccaaccccgugaucaccgaaagcacagaaaacagcaagaugaugcucgaacuggacccacccuucggcgacuccuauaucgucauuggagucggagaaaagaaaaucacccaccacuggcaccgcagcggcuccacaaucggcaaggccuucgaagcaaccguaagaggcgccaaaagaauggccguacuaggagacacggcaugggacuucggcagcguaggcggggcacucaacagucuaggaaagggcauccaccaaauauucggcgcagccuucaaaucacuauucggcggcaugagcugguucagucaaauacucauaggcacgcugcuaauguggcucggccucaauaccaaaaacggaucgaucucccucaugugccucgcccuuggaggcgugcuaaucuuccuauccaccgcagucagcgca

SEQ ID NO: 2944 - RNA, 2061 nt, Artificial Sequence
  KY075937.1 prME-short CDS opt
accuccguaggaauagucggccuccuccugaccacagccauggccgccgaagugaccagacgcggcucagcauacuacauguaccucgacaggaacgacgccggcgaagccaucucauucccgaccacauuaggcaugaacaaaugcuacauccaaaucauggaucuaggccacaugugcgaugccaccaugucauacgaaugccccaugcucgaugaaggcgucgaaccggacgacguagacugcuggugcaacaccaccuccaccugggucguauacggaaccugccaccacaagaaaggugaagcacgcagaagccgacgcgccgugacacuucccucacacuccacccgaaaacuacaaacacgcucacaaaccuggcuagaaucccgcgaauacaccaaacaccucauacgcgucgaaaacuggaucuuucgaaacccaggauucgcucucgccgcagccgcaaucgcauggcuucucggaucuuccacaucccaaaaagucaucuacuuaguuaugauccuccucaucgccccagccuacuccauacgaugcaucggcguaagcaaccgcgacuucgucgaaggcaugucgggaggcacguggguagacgucguucuagaacacgguggcugcguaacaguaauggcccaagacaagcccaccgucgacauugaacucgucaccaccacuguaucaaacauggcugaaguccgcagcuacugcuacgaagcaagcaucuccgacauggucuccgacagccgcugcccaacccaaggcgaagcguaccuagacaaacagucggacacccaauacgucugcaaacgcacccuagucgacagagguuggggcaacggaugcggacucuucggcaagggaucccuaguaacaugugccaaauucgcgugcucgaagaaaaugaccggaaaaagcauccagcccgaaaaccucgaauaccgcauaaugcucuccguccacggaagccaacacuccggcaugaucgugaacgacaccggacacgaaaccgacgaaaaccgcgcuaaaguagaaaucacaccaaacucaccccgcgcagaagcaacccuaggaggcuucggaucccucggccuagacugugaaccccggaccggccuagauuucuccgaccucuacuaccuaaccaugaacaacaaacacuggcucguacauaaagagugguuucacgacaucccccuccccuggcacgcgggcgcagacacagguacaccccauuggaacaacaaagaagcccuugucgaguucaaagacgcacacgccaaaagacaaaccgucgucgugcuuggcucccaggaaggagccgugcacacagcccuggccggagcgcuagaagcagaaauggacggcgccaaaggaagacuaagcuccggacaccuaaaaugccgacuaaaaauggacaaacuucgacuuaaaggagugucauacucacucugcacggccgcauuuaccuucaccaaaauccccgcagaaacacuacacggcaccgucaccgucgaaguacaauacgccggaaccgacggcccaugcaagguaccagcacaaauggccgucgacaugcagacacuuaccccgguaggccgacugauaaccgcuaacccagucaucaccgaaucaaccgaaaauucgaaaaugaugcuggaacucgacccacccuucggagacucauauaucgucauaggcguaggagaaaagaaaaucacccaccacuggcaccgcucuggcagcacaauaggaaaagccuucgaagccacagucagaggcgccaaacgcauggccgugcucggcgacaccgccugggacuucggaagcgucggaggcgcccucaacagccugggcaaaggaauccaccaaauauucggagcagccuuuaaaucccuuuucggaggaaugucaugguucucccaaauucuaauuggcacacuccuaauguggcucggacuaaacaccaaaaauggcucaauaagccugaugugucuagcacuaggaggcguacucaucuuccuuagcaccgccgucagcgca

SEQ ID NO: 2945 - RNA, 2061 nt, Artificial Sequence
  KY003156.1 prME-short CDS opt
accuccguaggcauagucggccuacuccugacaaccgcaauggcagccgaagucacacgccgcggaagcgccuacuacauguaccucgaccgaaaugacgccggcgaagccaucagcuuccccaccacgcucggcaugaacaaaugcuacauacaaaucauggaccucggccacaugugcgacgccaccaugucguacgaaugccccaugcuagacgaaggcgucgaaccagacgacguagacugcuggugcaacaccacaucgacauggguaguguacggaacaugccaccauaagaaaggagaagcaagacgcagcaggcgagcggucacccuacccagccacuccacgagaaaacuccagacacgcucccaaacauggcucgaaagcagagaauacacuaaacaccucauccgaguagaaaauuggauauuuagaaacccaggcuucgcgcuagcggcagccgcaaucgccuggcuacucgguaguuccacaucacaaaaaguaaucuaccucguaaugauccuccuaauugcaccagcauacuccauaagaugcaucggcaucuccaacagagacuucguggaaggcaugucagggggaacauggguagacguuguacucgagcacggcggcugcguaaccguaauggcccaagacaaaccaacaguggacaucgaacucguuaccacaaccgucaguaacauggccgaaguccguuccuacugcuacgaggccaguauauccgacauggccagcgacagccgcugcccaacccaaggggaagccuaccucgacaaacaaucagacacccaauauguuugcaaaagaacccuagucgaccgaggcuggggaaacggaugcggacuuuucggcaaaggcucgcucgucacaugcgccaaauucgcaugcuccaagaaaaugaccggcaaaagcauacaaccagaaaaccucgaauaccgcaucaugcucuccguacacgguagccaacacagcgggaugaucgucaacgacacaggccacgaaaccgacgaaaaccgcgcgaaagucgaaauaaccccuaacucaccccgugccgaagcaacacuuggcggguucgguauccugggccucgacugcgaacccagaaccggccucgacuucuccgaccucuacuaccuuaccaugaauaacaaacacuggcuaguccacaaagaaugguuccacgacauaccgcuccccuggcacgccggagccgacacaggcacaccccacuggaacaacaaagaagcccugguagaguucaaggacgcgcacgcaaaacgacagaccguagucgugcucggcagucaagaaggugcugugcacacggcacucgccggugcacuggaagcagaaauggacggagcaaaaggccgccuauccagcggccaucucaaaugccgacucaaaauggacaaacuacgucuaaaaggagugucguacagccuaugcacagccgccuucacauucacgaaaaucccagccgaaacacuacacggaacgguaacaguagaaguacaauaugcaggcaccgacggaccaugcaaaguacccgcccaaauggccguugacaugcaaacucuaacuccaguaggacgccugauuaccgccaacccagucaucaccgaaagcaccgaaaacucuaaaaugaugcucgaacuggacccaccauucggugacagcuacaucgucauaggcguaggagaaaagaaaaucacccaccacuggcaccgcagcggcuccaccauaggcaaagcauucgaagcaaccguccggggagccaaacgcauggcaguccucggcgacaccgccugggauuucggguccgucggcggggcccucaauucccuggggaaaggaauacaccaaaucuucggggccgccuucaaaagccuuuucggcggaaugucaugguucucucaaauacucaucggaacccuacuaauguggcuuggccugaacaccaaaaacggaagcaucucacucaugugccucgcacuuggaggcgugcucaucuuccuauccaccgcagucagugcc

SEQ ID NO: 2946 - RNA, 2061 nt, Artificial Sequence
  KU312313.1 prME-short CDS opt
acaagcguaggcaucguaggacuccuccuaacaaccgccauggcagcagaaguuacacgccggggaucagcauacuacauguaccuagaccgcaacgacgccggugaagccaucucguuccccacaacacugggcaugaacaaaugcuacauccaaaucauggaccucggacauaccugcgacgcaacaaugucauaugaaugccccaugcuagacgaaggcgucgaacccgacgacguagacugcuggugcaacaccaccagcacguggguagucuauggcaccugucaccacaagaaaggcgaagcacgccguucucgcagagcagucacccuacccucacacagcauccgcaaacuucaaacccgcucccaaacauggcucgagucccgggaauauacgaaacaccucauacgaguagaaaacuggaucuuccgcaaccccggcuuugcccuagccgcagcagcaauagccuggcuauuaggcuccagcaccagccaaaaaguaaucuaccuggucaugauccuccucauugccccugcauacucaauacgcugcaucggagucucaaacagggauuucgucgagggaaugucgggcggaacgugggucgacgucguccucgaacacgguggcugcgugacagucauggcccaagacaaaccgacaguugacauagaacuugucaccacaacaguaucaaacauggcggaaguccgcagcuacugcuacgaagccucaauauccgacauggcaagcgacagccgaugcccaacccaaggcgaagcauaccucgacaaacaauccgacacgcaauauguaugcaaacgcacccuaguagaccggggcuggggaaacggcugcggacucuucggcaaaggcagccuagucacaugcgcuaaauucgccuguagcaagaaaaugacaggcaaaagcauccaacccgaaaaucucgaguaccgaaucaugcuaagcguacacggcucacaacacucaggaaugauagucaacgacacaggacacgagacagacgaaaaccgcgcaaaagucgagauaacgcccaacuccccacgcgcagaagcaacacucggcggcuucggaagucucggucuagacugcgaaccccgaacaggacuagacuucucagaccuauacuaccugacuaugaacaacaagcacuggcucguccacaaagaaugguuucacgacauccccuuaccauggcacgcaggcgcugacaccggcacaccacacuggaacaacaaagaagcacucgucgaguucaaagacgcucacgccaaacggcaaaccgucguuguccugggcucccaagaaggcgcgguacacaccgcccucgccggcgcucucgaggcagaaauggacggagcaaaaggacgccucuccaguggacaccucaaaugcagacuaaaaauggacaaacuacgccucaaaggugucucauacagccucuguacagcagcauucaccuucaccaaaaucccggccgagacacuccacggaaccguaaccguagaaguccaauacgcagggacagacggacccugcaaagucccagcacaaauggcaguagacaugcaaacacuaacacccgugggaagacucaucaccgcaaaccccgucaucaccgaaagcaccgaaaacagcaaaaugaugcuagaacuagacccacccuucggcgacucauacauaguaauaggcgugggagaaaagaaaaucacccaccacuggcaccgcagcggaucaaccauaggcaaagcauucgaagccacaguccgcggugcaaaacgcauggccguccucggcgacacagccugggacuucggcagcguaggcggcgcccuaaacucgcuaggaaaaggcauacaccagaucuucggggcagccuucaagagucucuucggcgguauguccugguucagccaaauccucaucgggacccuacucauguggcucggccucaacgccaaaaacggcucgaucucacucaugugccuagcacucggcggcguccucauauuccugucaacagccguaagcgcc

SEQ ID NO: 2947 - RNA, 2061 nt, Artificial Sequence
  KY075935.1 prME-short CDS opt
acaucagucgggauagucggccuacuacuaaccacggccauggcagccgaaguaacccgacgcggaucggcauacuacauguaccuagacagaaacgacgcaggagaagccauaucuuuccccaccacauuaggcaugaacaaaugcuacauccaaaucauggaccuaggacacaugugcgacgcaacgaugucguaugagugccccaugcucgacgaagggguggaacccgacgacguagacugcuggugcaacacaaccucaaccugggucguauacggaaccugccaucauaagaaaggggaagcccaacgcucccgcagagccguaacacuacccagccacagcaccagaaaacuacaaacccgcucacaaaccuggcuggaaucacgcgaguacaccaaacaccuaauaaggguagaaaacuggauauuccggaacccaggcuucgcccucgccgcagcagcaauagcauggcuacucggauccucaacaucccagaaagugaucuaccucguuaugauacuccuuaucgcccccgccuacagcauccgaugcauaggcgucagcaaccgagacuucguagaaggaaugagcggcggcaccuggguagacgucguacucgagcacggcgguugugucaccgucauggcccaggacaaaccaacaguagacauugaacucgugacaacaacggucuccaacauggcagaaguacgcagcuacugcuacgaagccagcaucagcgacauggccuccgacagccgcugccccacacaaggagaagcguaccuggacaaacaaucagacacccaauacgucugcaaacgcacccuagucgaccgaggauggggcaacggaugcggccucuucggcaaaggaucgcucguaacaugcgccaaauucgccugcagcaagaaaaugaccggaaaaucaauccaacccgaaaacuuagaauaccgcauaaugcuaucaguccacggcucacaacacagcggcaugaucguaaacgacaccggccacgaaaccgaugagaaccgcgcaaaggucgaaauaacccccaacagcccccgcgccgaagcaacccuaggaggauuuggaagccucggccuagacugcgaaccacgcaccggccucgacuucuccgaccuauacuaccucaccaugaacaacaagcacuggcugguccacaaagaaugguuccacgacaucccccuccccuggcacgccggagccgacacgggaacaccccacuggaauaacaaagaggcccuaguagaguucaaagacgcacacgcgaaacggcaaacaguaguuguacucggaucacaagaaggggccguacacacagcccuagcaggagcacucgaagcggaaauggacggagccaaaggcagacucagcagcgggcaucuaaaaugccgacucaaaauggacaaacuccgauugaaaggcgucagcuacagccucuguaccgcagcauuuacauucaccaagauacccgccgaaacacuacacggaacaguaaccguagaaguccaauacgccgggacagacgggcccugcaagguacccgcacagauggcaguggacaugcaaaccuuaacaccgguaggacgacugaucacagcgaacccagucaucacggaaucaaccgaaaacuccaaaaugaugcuggaacuagacccgccuuucggcgauagcuacaucguaauuggagugggcgaaaagaaaaucacacaccacuggcaccgcuccggcucaacaaucggaaaagccuucgaagccaccguccgcggcgccaaaagaauggcaguccuaggagacacagcaugggacuucgguagcguaggcggagccuuaaacucacugggaaaaggcauccaccaaaucuucggagccgcauucaaaucacuauucggaggaauguccugguucagucaaauacucaucggcacgcuacucauguggcuaggacucaacaccaaaaacggaagcaucucgcugaugugccuagcccuaggaggcguacucauauuccuauccacagcggucucagca

SEQ ID NO: 2948 - RNA, 2061 nt, Artificial Sequence
  KY014320.1 prME-short CDS opt
acaagcgucggaauagugggacuccuacucacaacagcaauggcggccgaggucacacgacgaggaagcgccuacuacauguaccuagaccgcaacgacgcaggagaggccaucucguuccccacgacccuaggcaugaacaaaugcuacauccagaucauggaccucggucacaugugcgacgcaacaaugucguacgaaugccccaugcucgacgaaggggucgaaccagacgacguagacugcuggugcaacacaacaagcaccugggugguauacggcaccugucaccacaagaaaggagaagcccgaagaagccgcagagccguaacacucccaagccacuccacccggaagcuacaggcacgcagccaaaccuggcuagaaagcagagaauacaccaaacaccucauacgcgucgaaaacuggauauucagaaaccccggauucgcccuagccgccgccgccaucgcguggcuuuuagguuccuccacuagccaaaaaguaauauaccuaguaaugauacuccuaauagcgccagccuacagcaucagaugcauaggcguauccaacagagacuucgucgaaggcauguccggaggaacaugggucgaugucguacuagaacacggcggcugcguaaccgucauggcccaagacaaaccaacaguagauauagaacucgucacuaccacgguaagcaacauggccgaggugcgcucauacugcuacgaggccagcaucucagacauggcaucagacucacgcugcccaacacaaggagaagcauacuuagacaaacaaagcgacacacaauacguaugcaaacgcacccuaguagauagaggcuggggcaacgggugcggacucuucggcaaaggaucccuagucacaugcgcgaaauucgccugcucaaagaaaaugacaggaaaaucaauacaaccagaaaaccucgaauaccgcaucaugcuaagcgugcacggaucacaacacuccggcaugaucguaaacgacacaggccacgaaacagacgaaaaccgagcaaaaguggaaauaacaccuaacucaccacgcgccgaagccacccuagggggcuucggcucacucggccucgacugcgaacccaggacaggccuggacuuuucggaccuguacuaccuuacaaugaacaacaaacacuggcuaguacauaaagaaugguuccacgacauuccacuucccuggcacgcaggagccgacaccggcaccccacacuggaacaauaaggaagcacucguagaguucaaagacgcccacgccaagagacagacaguagucguacucggaucccaggagggcgcaguacacacggcccuagcgggcgcacuagaagccgagauggacggcgccaaaggccggcucagcagcggccaccucaaaugccggcuuaaaauggacaagcucagacugaaaggcguaucauacagccuaugcaccgccgccuucacguucacaaaaaucccagcggaaacacuacacggaaccgucacagucgaagugcaauacgcgggcacagacggccccugcaaagugcccgcccaaauggcggucgacaugcaaacacuaaccccaguaggaagacucaucaccgcaaacccggucauaacagaaagcacagaaaacagcaagaugaugcuagaacuagacccaccauucggcgacucauacauagucaucggcguaggagaaaagaaaaucacacaccacuggcaccgaagcggcucuacaaucggaaaagccuucgaagccaccguacgcggcgcgaaacgcauggccguccucggagacacagcaugggacuuuggcagcguaggaggcgcccucaacucccuaggcaaaggcauccaccaaauauucggggccgccuucaaaucccucuucggaggaaugucaugguucagccagaucuuaauaggaacccugcuaauguggcuaggccucaacacgaaaaacggguccauaucgcuaaugugccuagcacugggcggaguccucauauuccuaucaacagccguauccgcc

SEQ ID NO: 2949 - RNA, 2061 nt, Artificial Sequence
  KY328290.1 prME-short CDS opt
acaagcgucggcaucguaggccuccuccugaccacagccauggcagccgaaguuacacgccgaggaucagcauacuacauguaccucgaccgcuccgacgcgggagaagccaucagcuucccuaccacccucggcaugaacaaaugcuacauacaaauaauggaccugggacacaugugcgacgcaacaaugucguacgaaugcccaaugcuagacgaaggcgucgaacccgaugacguagacugcuggugcaacaccacauccaccuggguggucuacggaaccugccaccacaaaaagggcgaggccagacggucgagacgcgcggucacccuuccuagccacagcaccagaaaacuacaaacacggucgcagacuuggcucgaaaguagagaguauaccaaacaccucauccgggucgaaaauuggaucuuccgcaaccccggauucgcgcucgccgccgccgcaauagcguggcuacucggcagcuccacaagccaaaaagucauauaccucguuaugauacuccucaucgcccccgccuacuccauucgaugcauaggcguaagcaacagagacuucguagaaggcaugaguggagggaccugggucgacguaguccucgaacacggcggcugcgucaccguaauggcgcaagacaaacccacaguagacaucgagcuagucaccaccaccguaaguaacauggcagaaguccgauccuacugcuacgaagcaucaaucuccgacauggccuccgauagccggugccccacacaaggcgaagcauaccucgacaagcaaagcgacacucaguacgucugcaaaagaacacucgucgaccgaggcuggggaaauggaugcggccuauucgguaaaggcucccucguaaccugcgccaaauucgcauguucgaagaaaaugaccggaaaaagcauacaacccgagaaccuagaauaccguauaaugcuaagcguccacggaagccaacacagcggaaugaucgucaacgacacaggccaugaaacagacgaaaaccgcgccaaaguagaaauaaccccuaacucaccaagggcagaagcaacccuaggcggauucggaagccuaggacucgacugugaaccaaggacaggacucgacuucucagaccuauacuaccucaccaugaacaacaaacacuggcugguccacaaagaaugguuccacgacauuccgcuaccguggcaugcuggcgccgauacaggcacgccccauuggaacaacaaagaagcacucguagaguucaaagacgcccacgcaaaacgccaaaccgucgugguccuagggagccaggaaggagccguccacaccgcccucgccggagcccucgaagccgaaauggacggcgcaaaaggccgcuuaagcuccggccaccuaaaaugccgccugaaaauggacaaacucaggcucaaaggcguaagcuacucgcuauguaccgcagcauucacauucagcaaaaucccagcagaaacacuacacggcacagucacagaagaaguacaguacgccggcaccgacggccccugcaaaguccccgcgcaaauggccgucgauaugcaaacacuaacacccguaggccgacuaauaacagcaaaccccguaaucaccgaaagcaccgaaaacagcaaaaugaugcuggaacucgacccgcccuucggagacucauacaucguaauaggcgucggagaaaagaaaaucacucaccacuggcaccgcuccggcagcaccaucggcaaagccuucgaagccaccguccgcggcgccaagcgaauggcgguacuaggcgacacagccugggacuucggaucaguuggaggagcccuaaacucacuaggcaagggcauacaccaaaucuucggagcagccuucaaaucccuauucgggggcaugagcugguucagccaaauccuaaucggaacccuccucauguggcucggccuaaacaccaaaaacggcuccauuagucuaaugugccuagcccucggcggcgugcucaucuuccuauccacagcgguaucagcc

SEQ ID NO: 2950 - RNA, 2061 nt, Artificial Sequence
  KU681081.3 prME-short CDS opt
accucagucggaauaguaggacuacuccucacgacagcaauggccgcagaaguaaccagacgcgguuccgccuacuacauguaccucgaccgcuccgacgccggagaagccaucagcuuccccacaacccuaggcaugaacaaaugcuacauacaaaucauggaucucggacacaugugcgacgccaccauguccuacgaaugccccaugcucgacgaaggaguagagccggacgacguugacugcuggugcaacacaacauccacguggguagucuacggaaccugccaucacaagaaaggcgaagcccgaagaucccgccgcgccgucacacuacccagccacucaacgcggaaacuccaaacaagaucgcaaaccuggcuagaaagcagagaauauaccaaacaccuaaucagaguagagaacuggauauucaggaacccaggcuucgcacuagccgccgcagccauagccuggcuccucgguuccuccacaagccaaaaaguaauauaccucgucaugauacuccucaucgcaccagcauauucgauacguugcauaggagugagcaauagagacuucguagagggaaugucaggaggcaccuggguagacgucguacucgagcacggcggauguguaacaguuauggcccaagacaaacccaccgucgacauagaacucgucacaaccacagucucaaacauggccgaaguaagauccuacugcuacgaggcuuccaucucagacauggcauccgacucacgcugcccaacccaaggcgaagcguaucucgacaaacagucugacacccaguacgucugcaaacgcacacucguggacagaggauggggcaacggaugcggccucuucggcaaaggcucccuaguaacaugcgccaaauucgcaugcuccaagaaaaugaccggaaaaagcauacagcccgaaaaccucgaauaccgcauaaugcuaucaguccacggaucccaacacuccggcaugaucguaaacgacaccggccacgaaaccgacgaaaaccgcgcgaaagucgaaaucacccccaacagcccacgagccgaagccacacuagguggcuucggaagccucggacuggacugugaaccccgcacaggccuagacuucagcgaccuuuacuaccucaccaugaacaacaaacacuggcucguacacaaagaaugguuccacgacauaccacuaccguggcacacaggagcagacaccggaacaccacacuggaacaacaaagaagccuuaguagaguucaaagacgcccacgcaaaacgacaaacagucguaguacucggcucucaagaaggagccguccacaccgcacuagcaggcgcccucgaagccgaaauggacggagcuaaaggcaggcugagcucgggccaccuuaaaugcagacucaaaauggacaaacuuagacucaaaggaguaucauauucccucugcacagcagcauucaccuuuaccaaaauaccagccgaaacccuacacggaaccgugaccguagaaguucaauacgcaggaaccgacggcccaugcaaaguacccgcacaaauggcaguggacaugcagacccugacaccggucggacgccucauaacagccaaccccgucaucacugaaggcacagaaaacucgaaaaugaugcucgaacuagacccacccuucggcgacuccuacauagucaucggcgucggugaaaagaaaaucacacaccacuggcacagaagcggcucaacaaucggaaaagccuucgaagccaccguccgcggugcgaaaagaauggcaguccucggcgacacagcaugggauuucggaagcguaggcggaguacuaaacucgcucggcaaaggcauacaccaaaucuuuggcgcagccuucaaaagccuauucggaggcauguccugguucagccagauccuaaucggcacacuccuaauguggcugggacucaauaccaaaaacgggagcauaucccucaugugccuugcacuaggcggcguucucaucuuccucuccacagccgucagcgcg

SEQ ID NO: 2951 - RNA, 2061 nt, Artificial Sequence
  KX827309.1 prME-short CDS opt
accagcgucgguauagucggcuuacuccucacaacagcaauggcagccgaggucacccgaagaggaucagccuacuacauguaucuggaccgaucagacgcaggggaagcaaucuccuucccaacaacccuaggcaugaauaagugcuacauacaaauaauggaccucggacacaugugcgacgccacgauguccuacgaaugcccaaugcuugacgagggcguagaaccagacgacgucgacuguuggugcaacaccacguccacgugggucgucuacggaaccugccaccauaagaaaggcgaagcgcgacguagcagacgagcagucacucuaccaagccacagcaccagaaaacuacaaacaagaagccaaaccuggcuagaaagccgagaguacaccaaacaccuaauccgcguagaaaacuggaucuucaggaacccuggcuucgcacucgccgcagcagcaaucgccuggcugcucggaucaagcacaagccaaaaaguaauauaccuugugaugauccugcuaauagcccccgccuacuccauacgcugcauaggagucucaaaucgcgacuucguugaaggcauguccggcggcacaugggucgacguagugcucgaacacgguggcugcgucacagucauggcccaggacaaaccaacaguagacauagaacuuguaaccacuaccgucaguaacauggccgagguacguucauacuguuaugaagcauccauaucggacauggccucagacucccgaugcccaacccaaggcgaagcguaccucgacaaacaaucagacacacaauaugucugcaaacgcacccuagucgacagaggcuggggaaacggaugcggacucuucggaaaaggcucccucguaaccugcgcaaaauucgcgugcucaaagaaaaugacgggcaaaagcauacaacccgaaaaccucgaguaccgcaucaugcuaucaguccacgguucacagcauagcggcaugauaguaaacgacacaggacacgagacagacgagaaccgcgcaaaagucgagauuacaccuaauaguccccgcgcagaagccacauuaggcggauucggaagccugggacuagacugcgaaccucgaaccggacucgacuucuccgaccucuacuaccucaccaugaacaacaaacacuggcugguccacaaagaaugguuccacgacauccccuuaccauggcacgccggcgcggacacaggcaccccacacuggaacaacaaagaagcccuagucgaguucaaagacgcccacgccaaaagacaaacuguagucguccuaggaagccaagaaggagcagugcacaccgcacuggcaggcgcccuagaagcagaaauggacggcgccaaaggcagacugagcucaggccaccuaaaaugccgacucaaaauggauaaacuccgauuaaaaggggucucauacucccucugcaccgccgccuucacuuucacaaaaauccccgccgaaacccuccacgguaccgucaccgucgaaguacaauacgccggcaccgacggccccugcaaaguccccgcccaaauggccguagacaugcaaaccuuaaccccagucggacgccucaucacagcaaaucccgucaucaccgaauccaccgaaaacucgaaaaugaugcucgaacuagacccaccauucggagacagcuacaucgucaucggaguaggugaaaagaaaauaacccaccacuggcaccgcagcggaagcaccauaggaaaagccuucgaggccaccguccgaggagcaaaaagaauggcgguucucggugacaccgcaugggacuucggcagcguaggcggagcucugaacagccuaggaaaaggaauccaccaaauuuucggggccgcauucaaaagccucuucggaggaauguccugguucucgcaaauacucauuggcacacuccucauguggcucggacucaacacaaagaacggcagcaucagccucaugugccucgcccuugguggcguccucauauuccucagcacagccgucucagcc

SEQ ID NO: 2952 - RNA, 2061 nt, Artificial Sequence
  KU955593.1 prME-short CDS opt
accagcgugggcauagucggacuccuacucaccaccgccauggccgucgaagucacgcgccggggcaacgccuacuacauguaccuagaccguagcgacgcaggagaggcaauaucauuccccacaacaaugggaaugaacaaaugcuacauccagaucauggaccuaggccacaugugcgacgcaacaaugucauacgaaugcccaaugcucgacgaaggaguggaacccgacgacguagacugcuggugcaacacaacaagcaccuggguaguauacggaacgugccaccacaagaaaggcgaagcccgacggucccggcgagccgucacccucccaagccacuccacacgaaaauuacaaacaaggagccaaaccuggcucgaaagccgagaguacaccaaacaccucaucagaguggaaaacuggaucuuccgaaacccuggauucgcgcucgccgcagcagccauagcauggcuucucggcuccaguaccagccagaaaguuaucuaccucguaaugauccuacucaucgcuccagcauacuccauccgaugcaucggcgucagcaaccgcgauuucgucgaagguaugagcggcggcacauggguagacgucguacuagaacacggcggcugugugacagucauggcucaggacaaaccaacagucgauaucgaacucguaaccacaaccgucuccaauauggcagaagucagaucauauugcuacgaagcaagcaucuccgacauggccagcgacucacguugcccaacccaaggcgaagccuaccuggacaaacaguccgacacccaauacguaugcaaacgaacccucguugaccgaggcuggggcaacggcugcggccucuucggcaaaggaucacucguaacaugcgccaaauucgcuugcucaaagaaaaugacgggaaaaagcauacaacccgaaaaccuagaguaccguauaaugcucuccguccauggaucccaacacucaggcaugaucgucaacgacacgggccacgaaacagacgaaaaccgcgcaaaagucgaaauaacacccaacagcccccgagccgaagcaacacucggaggcuucgguagccucggccuagacugugaaccgcgcacaggacuagacuuuagcgaccucuacuacuuaaccaugaacaacaaacacuggcucguccacaaagaaugguuccacgacauaccauugcccuggcacgcaggggccgacacaggcaccccacacuggaacaacaaagaagcccucguagaguucaaagaugcacacgcuaaaagacaaaccgucgucguacucggcagccaagaaggcgccguacacacagcccuugcgggcgcacuagaagcagaaauggacggagccaaaggccgacugucauccggccaccucaagugcagacucaaaauggacaaacuccgccuaaaaggcguuuccuacagccucugcaccgccgccuucacauucaccaagauucccgcggaaacucuccaugggaccgucacaguagaaguacaauacgcaggaacagacggccccugcaaaguccccgcccagauggccgucgacaugcaaacccugacccccgucgggcgucuaaucacagccaacccgguaaucaccgaaucgaccgaaaacucaaaaaugaugcuagaacuugacccgcccuucggcgacuccuacaucgucauaggcguaggcgaaaagaaaauaacccaucacuggcaccgauccgguagcaccauagggaaagccuucgaagccaccguacgcggagcaaaaagaauggccguccucggagacacagcaugggacuucggaucgguaggcggagcacucaauucacuaggcaaaggcauacaccagaucuucggcgcagcauucaaaagccucuucggcggaaugagcugguucagccaaauccuaauaggaacccuacugguuuggcuaggccucaacaccaaaaacggcucaaucagccucaugugccuugcccuaggaggcguccucauauuucuaucaacugcagucucagca

SEQ ID NO: 2953 - RNA, 2061 nt, Artificial Sequence
  KY272987.1 prME-short CDS opt
accuccguaggcauagucggacuccucuugaccacagccauggcagccgaagucacccgacgcggcagcgcauacuacauguaccuagaccguuccgacgcaggcgaagcaauuagcuuccccaccacccuaggcaugaacaaaugcuacauacaaauaauggaucucgggcacaugugcgaugccacaaugucguacgaaugccccaugcucgacgaaggaguagaacccgacgacgucgacugcuggugcaacacaaccaguacauggguagucuacggaaccugccaccacaagaaaggugaagcucggagaucccgacgcgcggucacccuccccucccacuccacaagaaaacugcaaacaaggucacaaacauggcucgaaagcagagaauacaccaagcaccuaauaagaguggaaaacuggauauuucggaaccccggcuucgcguuagccgcagccgccaucgcguggcuccuagggagcucaacuucacaaaaaguaauauaccucgucaugauccuccugauagccccagccuacuccauacguugcauaggcguaucuaaccgcgacuucgucgaaggaauguccggaggcacaugggucgacgugguacucgaacauggcggcugcguaaccguaauggcacaagacaaaccgacgguagacauagaacugguuacaaccaccgucagcaacauggccgaaguaagaucauacuguuacgaagcaucaaucagcgacauggccagcgacucccgcugccccacccaaggagaagcguaucucgacaagcaauccgacacccaauauguaugcaaacgcacccucguggaccgaggauggggcaacggaugcggccuauucggcaaaggaucccuagucacaugcgcgaaguucgcaugcucaaagaaaaugaccggaaaauccauacaacccgagaaucucgaauacagaaucaugcucuccguacacgggucucaacauuccggcaugaucgugaacgacacuggccacgaaaccgaugaaaaccgagcaaaagucgagauaacaccaaauucaccccgcgccgaagccacccuaggaggcuucggaagccuaggccucgacugcgaaccccgaaccggacuggacuucuccgaccuguacuaccucacaaugaacaacaaacacuggcuaguccacaaagagugguuccacgacauaccacuucccuggcacgccggcgccgauacagggacaccccacuggaacaacaaagaagcccuuguagaguucaaagacgcacacgcaaaacgccaaacagucgugguccuaggcagccaagagggagccguacacaccgcccuagccggagcccuagaagccgaaauggacggcgccaaaggcagauuaagcuccggccaccucaagugccgacuaaaaauggauaaacugcgccuuaaaggcguaagcuacucccucuguacagcagcauucacauucacaaaaauacccgccgagacacuccacggaacaguaacagucgaaguccaauacgcaggaacagauggacccugcaaagucccggcacaaauggccguagacaugcaaacccuaacccccgucggcagacucauaaccgcaaaccccgucauaacagagucaaccgaaaacucaaaaaugaugcuggaacucgacccacccuucggcgacagcuacauaguaauaggcguaggcgaaaagaaaauaacacaccacuggcaccgcagcggaucaaccaucgggaaagccuucgaagccacgguccgaggcgcaaaaagaauggccgugcucggcgacacagccugggacuucggcagcgucggcggagcccucaacucccuaggcaagggcauucaccaaaucuucggagccgccuucaaaagccucuucggaggcaugucgugguucucccaaauacuaaucggcacccuccuuauguggcugggccucaacaccaaaaacggcuccaucucgcuagucugccuagcccucgggggaguccucauauuccuuucgacagcaguaagcgca

SEQ ID NO: 2954 - RNA, 2061 nt, Artificial Sequence
  KY007221.1 prME-short CDS opt
accucaguuggaauaguggggcuacuacuaaccacagccauggcggcagaaguaacccgaagaggcagcgccuacuacauguaccucgaccgcagcgacgccggcgaagcaaucagcuucccaaccacccuaggaaugaacaaaugcuacauccaaaucauggaccuaggucacaugugcgacgccaccaugagcuacgaaugccccaugcuugacgaaggaguugaaccagacgacgucgacugcuggugcaacaccacaagcaccugggucgucuacgggaccugccaccacaagaaaggcgaagcgcgccgaagccgcagagcugucacccuccccagccacuccacccgaaaacuacaaaccaggagccaaacauggcucgaaagccgcgaauauaccaaacacuuaaucagaguggagaacuggauauuccgcaaccccggauucgcacucgcagcggcagcgaucgcauggcuccuaggcagcuccaccagccaaaaagucaucuacuuagucaugauccuccucauagcccccgccuacucgaucagaugcaucggcguuaacaaccgagacuucgucgaaggcaugucuggcggcaccuggguugacgucguccuagagcacggcggcugcguaaccguaauggcucaagacaaacccaccgucgacaucgagcuagucacaaccaccguaagcaacauggccgaaguucgaagcuacugcuacgaagcauccauuagcgacauggcaucagacucaaggugcccaacacaaggagaggcuuacuuagacaaacaaagcgacacgcaauacgugugcaaacgcacccuagucgaccgcggauggggcaacggcugcggccucuucgguaagggcagccugguaaccugcgcaaaauucgccugcucaaagaaaaugacaggaaaaagcauacagcccgaaaaucucgaauaccguauaaugcuaagcguccacggaucacaacacagcggaaugaucgucaacgacaccggacacgaaacagaugaaaaccgagccaaagucgaaaucaccccaaacagcccccgcgcugaagccacccugggcggguucggaucacuaggccuagacugcgagccgcgcacaggccuggacuucagcgaccucuacuaccuaaccaugaacaacaaacacuggcucguacacaaagaaugguuccacgacaucccacucccauggcacgccggcgcagacaccggaaccccgcacuggaacaacaaagaagcacucgucgaguucaaagacgcccacgccaaacgccagacagucgucguccugggaucccaagaaggcgccguccacacagcacucgccggcgcccuagaggccgaaauggacggagcaaaaggacgccuaucaaguggccaucucaaaugccggcuuaaaauggacaaacuuagauugaaaggcgucuccuacucucucuguaccgcggccuucacauucacaaaaauacccgcggaaacacuccacggcacagucaccgucgagguccaguacgcagggaccgaugggccgugcaaaguaccagcccaaauggccguagacaugcaaacacuaacccccgucggacgucuaauaacagccaaccccgucauaacggaaucaacagagaacuccaaaaugauguuagaauuagacccuccauucggcgacucguacaucgucauagggguaggagaaaagaaaaucacacaccacuggcaccgcagcggaagcaccauaggcaaagcguucgaagccaccguacgaggcgccaaacgcauggccguccucggagauaccgccugggacuucggaagcgucggcggagcccucaacucucuaggaaaaggcauccaccaaauauucggagccgcauucaaaagccuauucggaggcaugucaugguucucccaaauacucaucggaacgcucuuaauguggcuaggccucaauaccaaaaacggcuccauaucccuagucugcuuagcccucggcggcguccuaauauuccuaagcaccgcaguaagcgca

SEQ ID NO: 2955 - RNA, 2061 nt, Artificial Sequence
  EU545988.1 prME-short CDS opt
acaucaguagggaucgucggucugcuccugaccacagcaauggcaguggaagucacacgacgcggcagcgcguacuacauguaccucgaccgaucagacgcaggcgaagcaaucuccuuccccaccacacucggcaugaacaaaugcuacauccaaaucauggaccuaggacacaugugcgacgcaacaaugucauacgaaugcccaaugcuggacgaaggaguagaacccgacgacgucgacugcuggugcaacacuaccagcacaugggucguauacgggacuugccaucacaagaaaggggaagcaagacgcucacgacgagcggucacgcucccgagccacucaacacggaaacuccaaacucggucgcaaaccuggcuagaaucaagagaguacacaaaacaccuaauacgaguagaaaacuggaucuucagaaacccaggcuucgcccucgccgcggccgccaucgccuggcuccuaggcagcagcaccucccaaaaagucauauaccugguaaugauccuacugauagcaccagccuacucaaucaggugcauaggaguaagcaaccgagauuucguagaaggaauguccggaggcacauggguagacgugguccuggaacacggcggaugcgugacagucauggcccaagacaaaccagccgucgauauagaacucgucaccacaaccguaagcaacauggcagaaguaagauccuacugcuacgaagccagcauaagugacauggcaagcgacagccgcugccccacccaaggcgaagccuaccucgacaaacaaucagacacccaguacguaugcaaacgcacauuaguagacagaggcuggggcaacggcugcggacuauucgggaaaggcucgcugguaaccugcgccaaauucgcgugcuccaagaaaaugaccggcaaaagcauacagcccgaaaaccucgaauaccggauaauguuguccgugcacggcagccaacacuccggcaugaucgucaacgacaccggacaugagacagacgaaaaccgcgccaaaguagaaauaaccccuaacagcccgcgagccgaggcgacccucggagguuucggcucguuaggccucgauugcgaaccccguaccggacuagacuucuccgacuuauacuaccucacgaugaacaacaaacacuggcuuguacacaaagaaugguuccacgacauaccacugcccuggcacgccggcgcagacacaggcaccccacacuggaacaacaaagaggcccuaguagaauuuaaagacgcccaugcaaaacgccaaacaguaguaguccucggcagccaagaaggcgcagugcacacagcacuagccggagcccuagaggccgaaauggacggcgcaaaagggcgacuaaguagcggacaccuaaaaugccggcucaaaauggacaaacuccgccucaaaggcgucuccuacucccuaugcaccgcagcauuuacauucacaaaaauccccgcagaaacccuacauggaaccgugacaguagaaguccaauacgcaggaacggacgggccaugcaaagugcccgcacaaauggcaguagacaugcaaacacucacaccagucggcagacuaaucaccgcgaaucccgugauaaccgaaucaaccgaaaacagcaaaaugaugcuagaacuagacccacccuucggcgacaguuacauagucauaggcguaggagaaaagaaaaucacacaccacuggcaccgauccggaucaacaauaggaaaagcguucgaagcgaccguacgcggagccaaacgaauggcaguucucggagacacagccugggacuucggaagcguaggcggcgcgcuaaacagccucggcaaaggcauccaucagaucuucggagcagcguucaaaucacuauucggagggaugagcugguucagucagauacuaauaggcacauuguuaguguggcucggccuaaacacgaaaaacggcagcaucagcuuaaccugccucgcacucggcggcguacucauuuuucuaagcaccgcaguaucagcc

SEQ ID NO: 2956 - RNA, 2061 nt, Artificial Sequence
  KU681082.3 prME-short CDS opt
acaucagucggcaucguaggccuccuucuaacaaccgcaauggccguagagguaacgcgucgaggcucagcguacuacauguaccuggaccgaucagacgcgggggaggcgauaucguucccaaccacgcucggaaugaacaaaugcuacauacaaauaauggacuuaggacacaugugcgacgccaccauguccuacgaaugccccaugcucgacgaaggaguggaaccagacgacgucgacugcuggugcaacacaaccaguaccuggguagucuacggcacgugccaccacaagaaaggcgaagcccgccgcucccgccgagcugucacacucccaagccauagcacacgcaaacugcagaccagaagccaaaccuggcucgaaucuagagaauauacaaaacaccugauccgcguagagaacuggauauucagaaacccaggauucgcccuagccgcagcagucaucgccuggcuacucggauccagcacaucacagaagguaauauaccucguaaugauauuacucaucgcaccagcguauucgauccggugcaucggcguaagcaaccgagacuucguugaaggaaugucaggcgggaccugggucgacgucguccuggaacacggaggaugcguuacggucauggcacaagacaaacccacagucgacaucgaacucgucacaacgaccguaaguaacauggcagaaguacgguccuacugcuacgaagcuagcauaucagacauggcuucagacuccagaugccccacacagggcgaagccuaccuagacaaacaaucagacacgcaauacgucugcaaacgaacccucguagaccgaggcuggggaaacggcugcggccucuucggcaaaggaucgcucgugaccugcgccaaguuugcaugcuccaagaaaaugacaggcaaauccauacaacccgagaaccucgaauaccgcaucaugcucagcguccacggaucacaacacucgggaaugauagucaacgacaccgggcacgagaccgacgaaaaccgcgccaagguggaaauaacaccuaacagucccagagcagaagccacacucggcggauucgggucacucggccucgacugcgaaccacgaaccggacuagacuucagcgaccucuacuaccugacaaugaacaacaaacacuggcuuguacacaaagaaugguuccacgauauaccacucccauggcacgccggggccgauaccgguaccccacacuggaacaacaaagaggcacucguagaguucaaagacgcacacgcaaaacgccaaaccgucgucguacucgggucacaagaaggcgccgugcauacagcccucgcuggcgcccuagaagccgagauggacggcgcuaagggucgacuuuccucaggccaccuaaaaugccgccugaaaauggacaaacuccggcucaaaggggucuccuacucacucugcaccgcagccuucacuuucaccaagauacccgccgaaacccuccacggcaccgucaccgucgaaguccaauacgcaggaaccgacggacccugcaaaguacccgcucaaauggcgguagacaugcaaacccugacgcccgucggccgccuaauuaccgccaauccugucauaaccgaaucgacagaaaacagcaaaaugaugcucgaacuggacccacccuucggcgacagcuacauagucaucggcgucggcgaaaagaaaaucacccaccacuggcaccgauccgguagcaccauaggaaaagcauucgaagccaccguacggggagcaaaaagaauggcgguacugggcgacaccgcaugggacuucgggagugucggaggagcccuuaacucguuaggcaaaggcauacaccagauauucggcgccgccuucaaaagccuguucggcggcaugagcugguucagccaaauccuaaucgggacacuccuggucuggcuaggccucaacaccaagaacggauccauuagccuaaccugccuggcacucggaggaguucuaauauuccucagcaccgccgucagcgca

SEQ ID NO: 2957 - RNA, 2061 nt, Artificial Sequence
  KX601167.1 prME-short CDS opt
acgagcguaggcauaguaggccuccuacuaaccaccgcaauggccguagagguaacccgccgaggcucagccuacuacauguaccuagaccgaagcgacgccggcgaagccaucagcuuucccacgacccuaggagucaacaaaugcuacauacaaauaauggaccucgggcacaugugcgacgcaaccaugucauacgagugcccaaugcuagacgaaggagucgaacccgaugacgucgauugcugguguaacaccaccucaacgugggucgucuacggaacaugccaccacaagaaaggcgaagcacggcggagcagacgagcagucacgcuaccaucccacucaacacgcaaacuccaaacccgaucacaaacauggcucgaaucccgcgaauacaccaaacaccuaaucagaguagaaaacuggaucuuucgcaaccccgguuucgcacucgcagcagccgcuaucgcauggcuacuaggcucauccaccucacagaaagucauuuaccucgugaugauccuacuaaucgcacccgcauacucgauccgcugcauaggaguuagcaaccgcgacuucguagaaggaaugagcggcggcacauggguagacguagugcuagaacacggcggcugcgucaccgucauggcccaggacaaacccacgguagacaucgaauuagucacuacaacggucagcaacauggcagaaguccgcucauacugcuacgaggcaagcaucuccgacauggcuuccgacagccgcugucccacgcagggcgaagccuaccuagacaaacaauccgacacacaauacgucugcaaaaggacccuaguagacagaggauggggaaacgggugcggacucuucggaaaaggcagccucgugaccugcgccaaauucgccugcucaaagaaaaugaccggaaaaagcauccaacccgaaaaucucgaguacagaaucaugcucagcguccacggaucacaacacagcggcaugauagucaacgacacggggcacgaaacggaugaaaaccgcgccaaagucgaaaucacccccaacagcccccgagccgaagccacccucggcggguucggaucgcuaggacucgacugcgaaccacgaacaggccuggacuucagcgaccucuacuaccuaacgaugaacaauaaacacuggcuaguacacaaagaaugguuucacgacaucccacuccccuggcacgccggagccgacaccggaacaccccacuggaacaacaaagaagcacugguugaguucaaggacgcacacgcaaaacgccagaccgugguugugcuaggcucacaagaaggcgcaguacacaccgcccuggcaggagcucuagaagccgagauggacggagccaaagggcgccucagcuccggacaccucaaaugccgccuaaaaauggacaaacuccgacuaaaaggagucucuuacucacucugcaccgccgcauucaccuucaccaaaauacccgcagagacccuccacggcacagugaccgucgaaguacaauacgccggaacagacggcccaugcaaaguaccggcccaaauggccguagacaugcaaacacucaccccagucggcagacuaaucacagcaaaccccgucauaacagaauccacagagaacagcaaaaugaugcucgaacuagauccgcccuucggcgauagcuacauaguaaucggugucggagacaagaagaucacccaccacugguaccgauccgguagcaccaucggcaaagcauucgaagccaccguccgaggcgccaaaagaauggcaguccucggcgacaccgcgugggacuucggcagcguaggaggagcccucaacucccucggaaaaggcauccaccaaaucuucggcgccgccuucaaaagccuauucgguggaaugagcugguucucccagauccugauuggcacgcuucuaguauggcuaggccuaaacacgaagaacggcagcauaucccucacgugccuugcgcuaggcggcguacuaauauucuuaagcaccgccguaagcgca

SEQ ID NO: 2958 - RNA, 2061 nt, Artificial Sequence
  KX694533.2 prME-short CDS opt
accagcgucggcaucgugggccuccuccuaacuaccgccauggccgucgaagucacacgccgcggcagcgcguauuacauguaccuggacagaagcgaugccggaaaagccauaucauuccccaccacccuaggaguuaauaaaugcuacauacaaaucauggaccucggccacaugugcgacgcaaccauguccuacgaaugcccaaugcuagacgaaggcguagaaccugacgacguggacugcuggugcaacaccacaucaaccugggucguuuacggcacaugccaccacaagaaaggggaagcccgacgcuccaggcgcgcggucacccucccaucacacucaacccgcaaacuacaaacacgaucccagacuuggcuagaaucgcgcgaauacaccaaacaccucaucagagucgagaacuggaucuuccgaaaccccggcuucgcacuagcagccgcugccauagcaugguuauuaggcucgagcaccucacagaaagugauauaucucgucaugauacugcucaucgcgccagcguacuccauucggugcauaggcguaagcaacagagacuucgucgaaggcauguccggcggaaccuggguagacgucguccucgaacacgguggcugcgugaccguaauggcccaagacaaacccacaguagacaucgaacugguuaccacaaccguauccaacauggccgaagugcgcucauauugcuaugaagccagcaucucagacauggcaucggacucccgcugcccaacacaaggagaagcguaccucgacaaacaaagcgacacccaguacgucugcaaaaggacacucgucgacagaggcuggggcaacggaugcggccucuucggcaaaggcagccucguaaccugcgccaaauuugccuguagcaagaaaaugaccggcaaaagcauacaacccgaaaaccucgaauaccggauuaugcucagcguccacggcucacaacacagcggcaugaucgucaaugacauaggccacgagaccgacgaaaaccgcgccaaagucgagaucacccccaacuccccacgcgcagaggcaacucucgggggauucggcucccucggcuuagacugcgaaccccgaaccggacucgacuucucagaccuguacuaccucaccaugaauaacaaacacuggcuaguccacaaagaaugguuccacgacauaccccuccccuggcacgcaggcgcggacaccggaacaccgcacuggaacaacaaagaggcccucgucgaguucaaagacgcacacgccaaacgucaaacaguagucguacucggcucccaagaaggcgccguacauaccgcacucgccggcgcccuagaagcagaaauggacggcgccaaaggacgucuaagcuccggccaccucaaaugcagacugaaaauggauaaacuacgccucaaaggcgucagcuacucccucugcacagccgcuuucacauuuaccaaaaucccagccgaaacauuacacggaacuguuaccguagaaguccaguacgccggcaccgacggcccaugcaaagucccagcccaaauggcagucgauaugcaaacacuuacaccagucggacgccucaucacagcaaacccgguaauaaccgaaucaaccgaaaacuccaaaaugaugcuagagcucgaucccccuuuuggcgacagcuacaucgucaucggagucggggacaagaaaaucacccaccacuggcaccgcucaggcuccaccaucgggaaagcauucgaagccacaguacguggugccaaacgcauggccguacucggcgacacagcgugggacuucggcagcgucggaggcgcacucaacucacucgggaaaggcauccaccaaaucuucggcgccgcauucaaaucccuauucggcggcaugucaugguucucccaaauacuaaucggcacccuacucgucuggcuaggacucaacaccaaaaacggaagcaucagccucacgugccuagcccucggaggcguccucauauuccucuccaccgccgucuccgcc

SEQ ID NO: 2959 - RNA, 2061 nt, Artificial Sequence
  KY288905.1 prME-short CDS opt
acaagcaucggcaucgucgggcuccuacucaccaccgcaauggccgcagaaaucacccgaagaggaagcgccuacuacauguaccuggaccggagcgacgcaggaaaagccauuagcuucgccaccacacuaggaguaaacaaaugucacgugcagaucauggaccuaggccacaugugugacgcgacaauguccuacgaaugcccaaugcuggaugaaggaguagaacccgacgacguggacugcuggugcaacacaacuagcacaugggucgucuacggcacaugccaccacaagaaaggagaggcccgaagaucccggcgcgcagucacccuaccgucccacaguacccgcaaacuccaaaccagaagccaaacauggcuagaaagcagagaauacacgaaacaccucaucaaaguugaaaacuggaucuuccgaaaccccggauucacgcugguagcagucgcaaucgcauggcuccuagggucuagcacuucacaaaaaguaauauaccucgucaugauccuucugauagcgccggccuacagcauacgcugcaucggaguauccaauagagacuucguagaggggauguccggcggcacaugggucgacguaguccucgaacauggaggcugugucaccguaauggcccaggacaagccaaccguagacaucgagcucguaacaaccaccguauccaacauggcggaaguaagaagcuacugcuacgaagccagcaucagcgacauggccuccgacucgcggugcccaacccaaggcgaagccuaucucgacaagcaauccgacacacaguacguaugcaaaagaacccucgucgaucgcggcuggggcaacgggugcggccucuucggaaaaggcagccucguaaccugcgcaaaauuuaccugcuccaaaaagaugaccggaaaaucaauccagccagaaaaccucgaauaccgcaucaugcucagcguccacggaagccaacauagcggcaugaucguaaacgacacaggacacgaaaccgacgaaaaccgcgcaaagguagaaguaacccccaacagcccacgcgcggaagcgacgcuaggaggcuucggaagccugggacucgacugcgaaccccgcacgggccuggacuucucagaccucuacuaccucacaaugaacaacaagcacuggcuaguccacaaagaaugguuccacgacaucccacucccguggcacgcgggcgcagacaccggaacaccccacuggaacaacaaagaggcccuaguggaguucaaagacgcacacgccaaacgacaaaccguagucguccuaggcagccaagaaggcgccguccacaccgcccucgcaggcgcccuagaagccgaaauggacggagcaaaaggacgacuauucucgggacaccucaaaugcagacucaaaauggacaaacuuagacuaaaaggggucucauacagccucuguacagcagcauucaccuucacgaaaguaccggccgaaacacuacacggaaccguaacaguagagguacaauacgcagggacggacggcccgugcaaagucccagcccaaauggcuguagacaugcaaacccuaacaccagucggccgccucauaaccgcaaacccaguuaucacagaaucaacagaaaacucaaaaaugaugcuagaacuagacccacccuucggagacagcuacauagucauaggaguuggagacaagaaaauaacacaccacuggcaccggucagggagcacaaucggaaaagccuucgaagcaaccguaagaggcgcaaaaagaauggcgguccuuggcgacaccgcaugggacuucggaucaguuggaggcguguucaacucacucgggaaaggcauacaccaaauauucggagcggcauucaaaucacuauucgggggaauguccugguucagucaaauacucauaggcacccugcuaguauggcuugggcuaaacacaaagaacggauccauaagccuaaccugccucgcacugggaggcgucaugaucuuccuaucaaccgccgugagcgcc

SEQ ID NO: 2960 - RNA, 2061 nt, Artificial Sequence
  KF268950.1 prME-short CDS opt
acaucaauagggaucauaggccuccuccugacaaccgcaauggcggcugagauaacgcgccgagggagcgccuacuacauguaccuagacagaucggacgcagggaaagcaaucagcuucgccaccaacuugggagucaacaaaugccacguccaaaucauggaccucggacacaugugcgacgccacaaugucuuacgagugccccaugcuagacgaagggguagaacccgacgacguggacuguuggugcaacaccacaagcaccuggguagucuacggaaccugccaccacaagaaaggcgaagcccggagaucccgccgagccguaacccuccccucccacucgacccgaaaacuccagacaagaagucaaaccuggcuugaauccagagaauacacgaaacaccuaauaaaaguugaaaacuggaucuuccgcaaccccggcuucgcccucgccgcggucgccauagccuggcuccuaggcagcucgaccagucaaaaaguaaucuaccuagucaugauccuacucaucgccccggcauacagcauacgauguaucggagugagcaaccgagacuucgucgaaggaaugagcggcggaacuuggguagacguugucuuagagcacggcggcugcguaaccgucauggcccaggacaaaccaaccgucgacaucgagcuagugaccaccacggucucaaacauggccgaagugagaucguacugcuacgaagccuccauauccgacauggcaucagacucgagaugcccaacacaaggcgaagccuaccucgacaaacaaagcgacacacaauacgugugcaaacgcacccuaguagacagaggauggggcaacggaugcggacucuucggaaaaggcagccuagucacuugcgcgaaauucacaugcagcaagaaaaugaccggcaaaagcauacaaccggaaaaccuagaauaccgcaucaugcucagcguacacgguucacaacacuccggcaugaucgucaacgacauaggacacgaaaccgacgaaaaccgcgcaaaaguggaagucaccccaaacucaccgagagcagaagcaacacucggcggauucggaucacuaggucucgacugcgaaccgcgcacuggccuagacuucuccgaccucuacuaccuuacaaugaacaacaagcacuggcuaguccacaaagaaugguuccaugacauuccguugccauggcacgcaggagccgacacaggaacaccacacuggaacaacaaagaagcgcuaguagaguucaaagacgcccacgccaagcgucaaaccgugguaguccuaggaagccaagaaggcgccgugcacacagcacuagccggagcacucgaagccgaaauggacggugccaaagggcgacuauucagcggccaccucaaaugcaggcucaaaauggacaaacugcgacuaaaaggaguaucguacucacuaugcaccgccgccuucacauucacaaaaguaccggccgaaacccuacacggcacaguaaccguggaaguccaguacgcaggaaccgacggaccuugcaaaguccccgcccaaauggccgucgacaugcaaacacucacacccgucggcagacugauaaccgcaaacccaguaaucaccgaaagcacugagaacagcaaaaugauguuagaacuagaucccccauucggcgacucauacaucgucaucggagucggcgacaagaaaauaacccaccacuggcaccgcaguggcucaaccaucggcaaagcauucgaagccaccguacgcggcgccaaacgcauggcaguccucggugacacagcaugggauuucggaagcgucggcggcgucuucaacucccucggcaaaggugugcaccaaaucuucggcgccgccuucaagagccucuucggaggcaugucgugguucucacaaauccuuaucgggacacuccuagucuggcuaggacuaaacaccaagaacggcaguaucagccuaaccugccucgcccuaggcgggguaaugauauuccuaagcacggccguaagcgca

SEQ ID NO: 2961 - RNA, 2061 nt, Artificial Sequence
  KF383121.1 prME-short CDS opt
accuccaucgggaucauaggccuauuacuaaccaccgcaauggcagccgagaucacccggcgcgguagcgccuacuacauguaccucgauagaucagaugcaggcaaagcaauauccuucgcaaccacacucggaguaaacaagugccacguccaaaucauggaccuaggccacaugugcgacgcaacaaugucauacgaaugcccaaugcuagacgagggcgucgaacccgacgacguagacugcuggugcaacaccacaagcacauggguagucuacggaacaugucaccacaagaaaggagaggccaggagaagccgacgcgcagucacccucccaagccacucgacacgaaaacuccaaacacgcagccaaacauggcuggaaagccgcgaauacaccaaacaccucaucaaaguagaaaacuggaucuuccgcaacccaggcuucgcacucguagccguagccauagccuggcuccugggaagcagcaccagccaaaaagucauauaccucguaaugauccuccugaucgcaccagccuacucgaucaggugcauuggcgucagcaaccgagacuucgucgaaggcauguccggaggcacauggguagacgucgugcuagagcacggcggcugcgucacggucauggcccaagacaaacccacgguggacauugaacucguaaccaccacagucagcaacauggcugaagucagaagcuacugcuacgaggcaucgaucagcgacauggccagugacucaagaugcccaacacaaggggaagcauaccucgacaaacagucagacacccaauacgucugcaagcgaacacucguagaccgcggcuggggcaacggcugcggacucuucggcaagggcucucuggucacaugcgccaaauucacguguagcaagaaaaugacuggcaaaucaauccaaccagaaaaucucgaauaccgaaucaugcuauccguacacggcucacaacacagcggcaugauaguaaaugacauaggucaugaaacugacgaaaacagagcaaaagucgagguaacccccaacagcccgcgcgcugaagcaacgcucggcggcuucgggagccuaggacucgacugcgaaccccgaacgggccuagacuuuagcgaucuguacuaccucacaaugaacaacaaacacuggcucgugcacaaagagugguuccacgacaucccccuccccuggcacgccggagccgacaccggcacaccccauuggaacaacaaagaagcccucguggaguucaaggacgcacacgcaaaacggcaaaccguagucguccuaggaucacaggaaggcgccguccacaccgccuuagcgggagcacucgaagcagaaauggacggcgccaaagggcgccuauucuccggacaccugaagugucgucucaaaauggacaaacuccgacuaaaaggaguguccuacagccucugcaccgcagcauucacauucaccaaaguccccgccgaaacccuccacgggacaguaacagucgaaguccaauacgccgguacagacggaccaugcaaaguccccgcccaaauggcaguagacaugcaaacacuaacccccgucgggcgacucaucaccgccaaccccguuauaacagaaagcacggaaaacagcaaaaugaugcuggaacuugacccucccuucggggacucauacauaguaauaggcgucggagacaagaaaaucacacaccauuggcaccgaagcggauccacaauaggaaaagcauucgaagccaccguacgaggggcaaaacggauggcaguacuaggcgacaccgccugggacuuuggcucaguaggcggcgucuucaacagccucgggaaaggcauccaccaaauauucggugccgccuucaaaucacucuucggcggaaugagcugguucagccaaauccugauuggaacccuacucgucuggcugggcuuaaacaccaaaaacggcagcaucucccugacaugucucgcccuagggggaguaaugauauuccuaucaaccgccgucagcgca

SEQ ID NO: 2962 - RNA, 2043 nt, Artificial Sequence
  KF268949.1 prME-short CDS opt
acaagcauagguaucauagggcuucuacucacaaccgccauggcagccgaaaucacccgacggggcuccgccuacuacauguacuuagacagaagcgacgcaggaaaagccaucucauucgccaccaaccuaggagucaacaagugccacguacaaauaauggaccugggacacaugugcgacgccacuauguccuacgaaugccccaugcucgacgagggcgucgaaccagacgacguugacugcuggugcaacaccacaagcacaugggucgucuacgggaccugccaccacaagaaaggcgaagcacgccggagccggcgcgccgucacgcuuccgagccacagcacccgcaaacuacaaacaagaucacagacguggcucgagagcagagaauacaccaagcaccucaucaaaguagaaaacuggauuuuccgcaaccccggauucgcucuagccgcagucgcaaucgccuggcuccuaggcucgagcacaagccaaaaagucaucuaccuaguaaugauccuccuaaucgcacccgcauacucaauacgcugcauaggcgucagcaaccgcgacuuuguagaaggaaugucaggagggacauggguagacguaguccucgaacacggaggcugcgucaccgucauggcacaggacaaacccaccguagacauagagcucguaaccacaacaguaagcaauauggcggaaguccguuccuacuguuacgaggcuucaaucucagacauggcgucagacucacgaugucccacccaaggcgaagcauaccuggacaaacaaucagacacccaauacguauguaaaaggacccucguugaccgcggcugggggaacggaugcgggcuauucggaaaaggaucccucgucaccugugccaaauucacaugcucaaagaaaaugaccggaaaaucaauccagccggaaaaccuagaauacaggauaaugcucucaguccacggaagccaacacagcggaaugauagucaacgacgaaaacagggccaaagucgagguuacacccaacagcccacgcgccgaagcaacacuaggaggauucgggagccuaggucuugacugcgaaccgcgaaccggccuggacuucucagaccucuacuaccuaaccaugaacaacaaacacuggcucguacacaaagaaugguuccacgacaucccgcucccguggcacgccggagcagacacaggcaccccacacuggaacaacaaagaggcccucguagaguucaaagacgcccacgcgaaacgccaaacaguaguaguacuggguucccaagaaggcgcaguccacaccgcgcuagcaggcgcacuagaagccgaaauggacggagccaaaggacgucuauucuccggacaccucaaaugccggcuaaaaauggacaaacuaagacucaaaggaguaucguacucccucugcacagccgccuuuacauucacgaaggucccagccgaaacccuacacggaaccgugaccgucgaaguacaauaugcgggaaccgacggcccaugcaagguaccagcccaaauggcagucgacaugcaaacccucacgcccgucggacgccucaucacagcaaauccaguaaucacagaaagcaccgaaaauucaaaaaugaugcuggaacuagacccacccuucggagacagcuacaucguaaucggcgucggagacaagaaaaucacacaucacuggcauaggagcgggagcacaauuggaaaagccuucgaagcaaccguaagaggcgccaaacgaauggcgguccuaggugacacagccugggacuucggcagcgucgggggcgucuucaacagccuaggcaaaggcauccaccaaauauucggagcagccuuuaaaagccuauucgguggcaugucaugguucagccagauccucauaggaacccugcuagucuggcuaggacuaaacacgaaaaacgggagcauaagccugacaugccucgcucugggaggcgucaugauauucuuaagcacggccguaagcgca

SEQ ID NO: 2963 - RNA, 2061 nt, Artificial Sequence
  KU955595.1 prME-short CDS opt
accagcauaggaauaguaggccuccuacucacaaccgccauggcggcggagaucaccagacgaggcagcgcauacuacauguaccucgacaggucagacgccgggaaagcaaucagcuucgcaaccacacugggagucaacaaaugccacguacagauaauggaccugggacacaugugugacgcaaccaugucauacgagugccccaugcuagaugaaggaguagagcccgacgacguagacugcuggugcaauacaaccagcacaugggucguguacggaaccugccaccacaagaaaggcgaagcuagaagaagccgcagagcgguaacccuaccaagccacagcacgcgaaaacuccaaacccgaagccaaaccuggcuugagagccgggaauacacgaaacaccuaaucaagguagaaaacuggauauuccgcaaucccgguuucgcgcucgucgcagucgcaauagcauggcuccuaggaagcagcacaagccagaaagugauauaccuaguaaugauccuacugauagccccagcguacagcauccgcugcaucggcguaagcaaccgcgacuucguagaaggaauguccggaggcacauggguagacguaguccucgagcacggcggcuguguaacaguaauggcacaagacaaaccaacggucgacauagagcuagucaccacaacaguaagcaacauggcagaagugcgaagcuacugcuacgaagcauccaucucagacauggccagcgacagucgaugccccacacaaggcgaagcauaccuagacaaacaauccgacacccaauacgucugcaaaagaacgcuagucgauagagguuggggcaacggcugcggauuauucggcaaaggcucgcuagugacaugcgcgaaauucacaugcagcaagaaaaugacgggcaaaagcauccagcccgaaaaccucgaguacagaauaaugcuauccguccacggcagccaacacagcggcaugauagucaacgacacugggcacgaaacagacgaaaacagggccaaaguagaagucaccccaaacagcccacgcgcggaagcgacccucggaggguucgggucacucggacuagacugcgaaccacgaacagggcucgacuucuccgaccucuacuaccuaacgaugaacaacaaacacuggcugguacacaaagagugguuccacgacauacccuugccauggcacgcaggggcggacacaggaaccccacacuggaacaauaaagaggcgcuagucgaguucaaagacgcacacgcaaaacgacaaacaguaguaguacuaggaagccaagaaggcgcaguacacacagcacuagccggcgcgcuggaagccgaaauggacggcgcaaaaggacgacuauucagcggccaccugaaaugcaggcucaaaauggacaaacugagacugaaaggagucuccuacucacuaugcacagcagcauuuaccuucacgaaaguaccagccgaaacccuacacggaacaguaacgguagaaguccaguacgcaggaacagacgggccaugcaaaguaccagcacagauggccgucgacaugcagacccucacaccagucgggcgccuaauuacagccaacccgguaaucacagaaagcaccgaaaacuccaagaugaugcuagaacuagacccacccuucggcgacagcuacaucgugaucgguguaggugacaagaaaaucacacaccacuggcaccggagcggcagcacaauagggaaagccuucgaagcgacaguacgcggcgcgaaacgcauggccguacucggcgacaccgcaugggacuucggaagcgugggcggcgucuucaacagccucggaaaagguauccaccaaaucuucggggcagccuucaaaagccucuucgggggaaugagcugguucucacaaauacuuauagggacacugcuaguauggcucggccucaacaccaaaaacggaagcauaagccuaaccugccuagcacugggaggcgugaugauauucuuaagcacagccgucucggca

SEQ ID NO: 2964 - RNA, 2061 nt, Artificial Sequence
  KF383116.1 prME-short CDS opt
acgagcauaggaaucgucggacuacuacuaaccaccgcaauggccgcagaaaucacacgcagaggaagcgcauacuacauguaccuagauaggagcgaugccggcaaagccaucagcuucgcgacaacacuaggugucaacaaaugccacguacaaauaauggaccuaggccauaugugcgacgccaccaugucauacgaaugccccaugcuagacgaaggcgucgaaccagacgacguggacugcugguguaauaccacauccaccuggguagucuacggcacaugccagcacaagaaaggagaggcacgacgcucaagacgagcgguaacacuacccagccacucaacccgcaaacugcaaacgcgcucacaaacauggcuagaaucaagggaauacacaaaacaccuaauaaaagucgaaaacuggauauuccgcaaccccggcuucgcacuggucgcaguagcaauagcguggcuccuaggcucgaguaccucccaaaaagucauauaccucgucaugauccuccucauagccccagcauacuccauccgcugcaucggcgucagcaacagagacuucguagaaggcaugucuggaggcacauggguggacguggugcuagaacacggaggcugcgucaccguaauggcccaagacaaacccacagucgacaucgaacucgucacaaccacgguuagcaacauggcagagguacgcuccuacugcuaugaagccagcauaucagacauggcaagcgacucgcgcugccccacccaaggcgaagccuaccucgacaaacaaagugacacgcaauacguaugcaaaagaacccuagucgaccgaggcuggggaaacgguugcggccucuucggaaaaggcagccuaguaacaugcgccaaauucacaugcuccaagaaaaugacagggaaaagcauacaacccgaaaaccuggaauacagaaucaugcuuagcguacacggcagccaacauucagguaugauaguaaacgacaucggccacgaaaccgaugagaaccgcgccaaaguagaagucacccccaauuccccgcgcgccgaagcaacccuaggcggauucggaucacucggccuugacugcgaaccccgcacaggacucgacuucagcgaccucuacuaccuaacaaugaacaacaaacacuggcucguacacaaagagugguuucacgacaucccccuacccuggcacgccggagccgacaccggaacaccccacuggaacaacaaagaagcccuaguggaguucaaagacgcacacgccaaacgccaaaccguagucguccuaggcagccaagaaggcgccguccacacugcguuagcaggagcauuggaagccgaaauggacggggccaaaggucggcuauucagcggccaccugaaaugccgccucaaaauggacaaacuucgccuaaaaggcgucuccuauucacucugcaccgccguaugcacagcagccaaaguaccggcggaaacccuacacggcaccguaacggucgaaguacaauacgcaggaacagacgguccaugcaaaguacccgcucaaauggccguagacaugcaaacccucacccccguaggcagacuaaucaccgccaacccaguaauaaccgaaagcacggaaaacuccaaaaugaugcuagaacuagacccgcccuucggcgacagcuacaucgucauuggaguaggggacaagaaaaucacacaccacuggcacagauccggauccacaauaggcaaagcguucgaagcaaccguccgcggcgcaaaacgcauggccguccucggcgacacggcgugggacuucgguucaguaggcggagucuucaacucccuaggcaaaggaauacaccaaaucuucggcgccgcauucaaaucgcuguucggcggcaugucgugguucucacaaauacucaucgggacccuccuaguauggcugggacucaauaccaaaaacggaucaaucucacucacaugccuggcgcugggcggcguaaugauauuccuaucaacagcagucucggcc

SEQ ID NO: 2965 - RNA, 2043 nt, Artificial Sequence
  KX601166.1 prME-short CDS opt
acuagcaucggcaucgucggccuccuacugaccacagcuauggcagcagaaaucacccgacggggguccgcauacuacauguaccuagaccgcucagacgccggaaaagcgaucuccuucgcaacaacgcuaggagucaacaaaugccacguccaaaucauggaccuaggccacaugugcgacgcuacaaugagcuacgaaugccccaugcuagaugagggcguagaacccgacgacgucgacugcuggugcaacaccacuagcacguggguaguauauggcacaugccaccacaaaaagggagaagcacggcggagccgacgcgcaguaacacucccaagccacagcacacgaaaacuccaaacccguagccaaacguggcucgaauccagagaauacaccaaacaccuaaucaaaguagaaaacuggaucuuccgaaacccaggcuucgcccucguagcagucgcaauagcauggcuccuaggauccaguacaagccagaaaguaaucuaccuaguaaugauccuccuaauagcacccgccuacuccaucagaugcauaggcguaagcaaccgagacuuuguggaaggaauguccggcggaacauggguagacgucgugcuggaacacggaggcugcguaacgguaauggcgcaagacaaacccaccguagacaucgaacuggucaccaccaccguaucaaacauggcagaaguacgcuccuacugcuacgaagcgucaauaucagacauggccucggacucccggugcccaacccaaggcgaggcauaccuagacaaacaauccgacacccaauacgucugcaaacgaacccugguugaucgaggaugggguaacggcugcggacucuucgguaaaggcagucuagucaccugugcaaaauucacaugcucaaagaaaaugaccggaaaaucaauucaaccagaaaaccucgaauaucgaauaaugcucucaguacacggaagccaacacucaggcaugauagucaaugacgaaaaccgcgccaaaguugaagucaccccaaacagucccagagcagaagccacgcucggcggguucgggagccuaggacuggacugugaaccccggacgggccuggacuucagcgaccuauacuaccucaccaugaacaacaaacacuggcuaguacacaaagaaugguuucacgauauaccccucccguggcacgccggcgccgauaccggcacuccccacuggaacaacaaagaagcacuggucgaguucaaagacgcacacgcaaaacgccaaacugucguaguccucgggucccaagaaggcgccguacacacagcacucgccggcgcgcucgaggcagaaauggacggcgccaaagguagacucuucucaggacaccuaaagugccgccuuaaaauggacaaacuccgccucaaaggagugucguacuccuuaugcaccgccgcauucaccuucacaaaaguaccagccgagacacuccacggcaccguaaccguagaaguacaauacgccgggaccgacggaccaugcaagguacccgcacaaauggccguagacaugcaaacacucacgccagucggacgccucaucaccgcaaaucccgucaucacagaguccaccgagaacuccaaaaugaugcucgaacucgaucccccauucggcgacuccuacauagucaucggcgucggagacaagaaaaucacccaccacuggcaccgauccggcucgaccaucggcaaagccuucgaagccaccguaagaggcgccaaacggauggccguccugggcgacacggccugggacuucggauccgucgguggcguuuucaacucacucggaaaaggaauccaccaaaucuucggagccgccuucaaaucacuauucggaggcauguccugguucagccaaauccucaucggaacccuacucgucuggcuuggucucaacaccaaaaacggcagcaucagcuuaacaugccucgcacucggaggcguaaugaucuuucucuccaccgccgucagcgca

SEQ ID NO: 2966 - RNA, 2061 nt, Artificial Sequence
  KF383118.1 prME-short CDS opt
acaagcauuggcauuauaggccuacuucucaccacugccauggccgccgaaauaacacgacgaggaagcgccuacuacauguaccuagacagaucggacgcaggcaaagcaaucagcuucgcaacaacccucggagucaacaaaugccacguacaaaucauggaccuaggacauaugugcgacgcaacaaugucauacgaaugccccaugcuggacgaaggcgucgaacccgacgacguagacugcuggugcaacaccacaaguaccuggguagucuacggaaccugccaccacaaaaagggagaaacccgacggucccgcagaucaguaucccuccgcuaccacuacacaagaaaacuccaaacccgaagccaaaccuggcucgaaucccgcgaauacaaaaaacaccuaaucaugguagaaaacuggauauuccggaacccaggauucgccaucgugaguguagccaucacauggcucaugggcagucugaccagccaaaaagucaucuaccucguaaugaucgugcuaauaguacccgccuacagcaucucaugcaucggcgucucaaaccgcgaccucguagaaggaauguccggaggcaccugggucgacgugguucucgaacauggaggaugcgugacggaaauggcccaagacaaaccaaccgucgacaucgaacucguaacgaugaccgucagcaacauggcagaagucagauccuacugcuaugaagcgucccucagcgacauggcaagcgccagccgaugccccacacagggcgagcccucacucgacaaacaaucagacacacaaagcgucuguaaaagaacccucggggaccgaggcuggggcaacgggugcggcauauucggaaaagguucgcuaguaacaugcucaaaauucaccugcugcaaaaaaaugcccggcaaaucgauacaaccagagaaccucgaauacagaauaaugcuacccguacacgggagccaacacagcggcaugauaguaaacgacauaggacacgagacagacgagaacagagcaaaaguagaagucacgccaaauuccccgcgagccgaagcaacacucggaggcuucggaagccuagggcucgacugcgaaccacgcaccggccucgacuucucagaccuauacuaccugaccaugaacaacaaacacuggcuuguccacaaagaaugguuccacgauaucccucuacccuggcacgccggagcagacaccggcacaccccacuggaacaacaaagaggcccugguagaguucaaagacgcacacgcaaaacgucaaaccgucguggucuuaggcagccaagaaggcgccguacacaccgcacucgccggcgcccucgaagcggagauggacggggcuaaaggacgccuguucucaggccaucucaaaugccgucuaaaaauggacaaacuaagacuaaaaggaguaucguacagccucugcaccgccgccuucacauucaccaaaguaccggcagaaacacugcacggaacagugacaguggaaguccaaagcgccggaacagauggacccugcaaaguccccgcccagauggccguagacaugcaaacacucacacccguaggccggcuaaucacagcaaacccgguaaucaccgagucaacagaaaacuccaaaaugaugcuggaacuggauccgccauucggagacucauacauagucauagguguaggagacaagaaaauaacccaccacuggcaccgaagcggcagcaccauaggaaaagccuucgaagccacgguacgcggagccaaaagaauggccgugcucggagacaccgccugggacuucggcucaguagggggcguauucaacagccuaggaaaaggcauacaccaaaucuucggagcagcauuuaaaagccuauucggaggaaugagcugguucucacaaauacuaaucggaacccuacuaguguggcuaggacucaacaccaaaaacggcagcaucucacucacgugccuagcccugggaggagucaugauauuccucuccacagccguauccgcu

SEQ ID NO: 2967 - RNA, 2058 nt, Artificial Sequence
  KX447520.1 prME-short CDS opt
agcguaggcauagucggccuacuccugacgaccgcaauggccgcagaagugacacggcggggcagcgccuacuacauguaucuggacagaaacgacgcgggggaagccaucucauucccaacgacccuaggcaugaacaaaugcuacauacaaauaauggaccuagggcacaugugcgacgcaacgauguccuacgagugcccgaugcucgacgaagguguagaaccagacgacgucgauugcuggugcaacaccacauccacauggguaguauacggcacuugccaccauaagaaaggggaagcacgccgcagccgacgcgccguaacacucccuagccacuccacgcgcaaacuacaaacaagaagccaaaccuggcuagaaucuagagaauacacgaaacaccugauaagaguagaaaacuggaucuuccgaaacccgggauucgcccucgccgcagccgccauagcauggcuccucggaagcaguaccagucaaaaaguaaucuaccugguaaugauccuccuaaucgcacccgcguacagcaucaggugcaucggcgugagcaaccgcgacuucguagaagggaugagcggcggaacaugggucgacgucguccuagagcacggaggaugcgucacaguaauggcacaagacaaaccuacgguagacaucgagcucgucaccaccaccguaaguaacauggccgaaguacggucauauugcuacgaagcauccauaagcgacauggccagcgacucccgauguccaacucaaggagaagcauaccuagacaaacaaucggacacacaauacguaugcaaaagaacccucguagacagaggauggggcaacggaugcggacuauucggaaaaggcucgcuaguaaccugcgccaaauucgcgugcuccaagaaaaugacaggaaaaagcauucaaccagaaaaccuagaauacagaauaaugcuguccguacacggaagccaacauagcggaaugaucgucaacgacaccggacacgaaacggacgagaacagagcaaaaguagaaaucaccccaaacaguccccgcgcagaggcgacgcuaggagguuucggaagccuaggacuggacugcgaaccccgcacgggccucgacuucagcgaccuguacuaccucaccaugaacaacaaacacuggcuagugcacaaagaaugguuucacgacaucccccuaccguggcacgcaggcgcagacacaggaacaccgcacuggaacaacaaagaagcacuggucgaguucaaagacgcccacgcaaaaagacagacaguggugguccugggcagccaagagggagccguacacacagcgcucgcgggagcacuggaagccgagauggacggcgcaaaaggacgccuguccucaggacaccucaaaugccgacuaaaaauggacaaacucagacucaaaggagucagcuacucacuuuguacagccgccuucacauucacaaaaauaccagccgaaacacuacacggaacaguaaccgucgaaguacaguacgcaggaacagacggaccgugcaaaguccccgcgcaaauggcaguagacaugcaaacccugaccccagucggacgacuaauaaccgcaaaccccguaaucacagaauccaccgaaaauuccaaaaugaugcucgagcuagacccacccuucggcgacagcuacauagugaucggcgucggggaaaagaaaauaacccaccacuggcaccgaagugggaguacaauaggcaaagcauucgaggcaaccgucagaggggccaaacgaauggcaguacugggagacacagcaugggacuucggaucagugggcggagcccuaaacucacucggaaaaggaauccaucaaaucuucggggccgcguucaaaucacucuucgguggcaugagcugguucagccaaauacucauaggcacacuccuaauguggcucggacugaacacgaaaaacggaagcauaagccugaugugccuggcacuaggcggcguccucauauuuuuaaguacagccguaagcgcc

SEQ ID NO: 2968 - RNA, 2061 nt, Artificial Sequence
  KU761561.1 prME-short CDS opt
accuccguggggauagucggacuacuccugacaaccgccauggccgccgaaguuacccgacgaggcagcgccuacuacauguaccucgaccgcaacgacgccggcgaggcaaucuccuuccccaccacgcuaggcaugaacaaaugcuacauacaaaucauggaccucggacacaugugcgacgcaacaaugagcuacgaaugccccaugcucgacgagggagucgaacccgacgaugucgacugcuggugcaacacaaccagcaccugggucguguacggaaccugccaccacaaaaagggcgaagcgcgccgcucccggcgcgccgucacccuccccagccacucaacacgaaaacuacaaacacgaagccaaacauggcuggaaucacgagaauacaccaaacaccuaauacgagucgaaaacuggauauuccgaaaccccggcuucgcacuagccgccgcggccauagccuggcuccucggcucaucaaccucccaaaaaguaaucuaccucguaaugauacuccuaauagcccccgcauacucgauaagaugcauaggcgucagcaaccgcgacuucguagaaggaaugagcggcggcaccugggucgacguuguccuagaacacggcggaugcgucacaguaauggcccaagacaaaccuaccgucgacauagaacucgucacaacaaccguuuccaacauggccgaaguacgaucauacugcuacgaggcuucaauauccgacauggccucggacucccgcugccccacccaaggcgaagccuaccucgacaaacagagcgacacccaauacgucugcaaacgcacgcuagucgaccgcggauggggcaacggcugcggacuauucgggaaaggaucccuaguaacaugugcaaaauucgccugcucaaagaaaaugacggguaaaucaauccaaccggaaaaccucgaguaucgaaucaugcucuccguccauggcucccaacacuccggcaugauaguaaaugacacaggccacgaaaccgaugaaaacagagcuaaaguugaaauaacccccaacucaccacgcgccgaagccacccugggcggcuuuggaucacugggccucgacugcgaaccccgaaccggucucgacuucagcgaccuguacuaccuaacaaugaacaacaaacacuggcuaguccacaaggagugguuccacgacaucccacucccauggcacgccggagcagacacaggcaccccacacuggaacaacaaggaagcccuagucgaguucaaagacgcacacgcaaaacgacaaacggucgucguccuagggagccaagaaggagcaguacacacagcacucgcaggggcgcuagaagcagaaauggacggggcaaaaggacgccuuuccagugggcacuuaaagugcagacucaaaauggacaaacuuagauuaaaaggcguaucauacucacuaugcaccgccgccuucaccuucaccaaaauacccgccgaaacgcugcacggaacagucacgguugaaguccaauacgccggcacagacgggcccugcaaaguacccgcgcaaauggcggucgacaugcagacacuuacccccguuggucggcuaauaacggccaacccagucauaacagaaagcaccgaaaacuccaaaaugaugcuagaacucgacccacccuucggagacagcuacaucgucaucggcguuggcgaaaagaaaaucacacaucacuggcacagaucagguagcaccauaggcaaagccuuugaagccacagucagaggcgccaggcguauggcaguccucggagacaccgccugggacuuuggauccgugggaggcgcacuaaacucccuaggcaaaggcauccaucaaauauucggggccgccuucaaaucgcuguucggcggaaugucaugguucagccaaauccuaaucggaacgcuccuuauguggcucggccuaaacaccaaaaacggauccauaucccucaugugccuggcccucggaggcguccuaaucuuccuguccacagcggucuccgcg

SEQ ID NO: 2969 - RNA, 2061 nt, Artificial Sequence
  KX806557.2 prME-short CDS opt
accuccguuggcaucgugggccuccuccuaacaaccgcaauggccgccgaaguaacccgacguggaagugcauacuacauguaccuagaccgcaacgacgcaggagaagcaaucucauucccaaccacccuaggcaugaacaaaugcuacauccaaaucauggaccuaggccacaugugcgacgcaaccaugucauacgaaugccccaugcuagacgaagguguugaaccagacgacguagacugcuggugcaacacaacauccaccuggguagucuacggcacaugccaccacaaaaagggagaagcacggcgcucccgccgagccgucacccugcccagucacuccacccgcaaacuccaaacccgaucccaaaccuggcuagaaagccgcgaauacacaaaacaccuaauaagaguagaaaacuggauguucagaaaccccggauucgcccucgccgcagcagccauagcauggcuccucggcucauccaccucacaaaaaguuauauaccucgucaugauccuacuaauagccccagccuauagcaucagaugcaucggcgucuccaaccgagacuucgucgaaggaaugucaggaggaaccuggguggacgucgugcucgaacacgggggcugcgugaccguaauggcacaagacaaaccaacgguagacaucgagcuagucacaacaacuguguccaacauggccgaaguacgaagcuauugcuacgaagcauccaucucggacauggccagcgacucucgaugccccacccaaggcgaagcauaccuggacaaacaauccgacacccaauacguaugcaaacguacucuaguagaccgcggcugggggaacgguugcggacuguucggaaaagggucacugguaaccugcgcaaaguucgcgugcucuaagaaaaugaccggaaaauccauccaaccagaaaaccuagaauaccgcaucaugcuauccguccacggaucccagcacaguggaaugauugucaacgacaccggacaugaaacagacgaaaaccgcgccaaaguagaaauaacaccaaacucaccccgcgccgaagcaacacucggcggauucggcucacucggacucgacugcgaaccccgcaccggccucgacuucucagaccuguacuaccucacaaugaacaacaaacacuggcucguacacaaagaaugguuccacgacauaccacucccuuggcacgcgggcgccgacacagguaccccacacuggaacaacaaagaagcccuagucgaguucaaagacgcacacgccaaaagacagacgguagucgugcucggaagccaggaaggagccguacacaccgcccucgccggggcacuggaagcagaaauggacggcgcuaaaggccgccucucauccggccaccuaaaaugccgguuaaaaauggacaaacugagacucaaaggaguaagcuacuccuuaugcaccgccgccuucaccuucaccaaaauaccggccgaaacccuccacgguaccguaacaguagaaguccaauacgccggaacagacggccccugcaaagucccugcccagauggcugucgacaugcaaacccucacccccgucggaagacuaaucacugccaaccccgucauaaccgaauccaccgaaaacagcaaaaugauguuggaacucgaucccccauuuggcgacucauacaucgugauaggcguaggcgagaaaaagauaacacaccacuggcaccguuccggaaguaccaucggcaaagcauucgaagcgaccguccgaggcgcaaaacgaauggccguacucggggacacggccugggacuucgggagcgugggcggcgcacuaaacucccucggcaaaggaauccaccaaaucuucggcgccgccuucaagucccucuucggaggcaugucgugguucucccagaucuuaaucggaacucuacucauguggcuaggguugaacaccaaaaacggaucaauaucccuaaugugcuuagcccuuggaggaguacuaaucuuccuaagcaccgcagugucagcc

SEQ ID NO: 2970 - RNA, 2061 nt, Artificial Sequence
  LC191864.1 prME-short CDS opt
accaguguaggcauagugggacuacuacucacuaccgccauggcagccgaaguaacaaggcgaggauccgcguacuacauguacuuagaccgcaacgacgcaggagaagcaaucuccuuucccaccacacucggaaugaacaaaugcuacauccaaauaauggaccuaggccacaugugcgacgccacaauguccuacgaaugcccgaugcucgacgaaggagucgagccagaugacguagacugcuggugcaacaugaccagcaccugggucgucuacggcaccugccaccacaaaaaaggagaggcgcgaagauccagacgggccgucacacuaccaagucacuccacgcguaaacuccagaccagaagccaaaccuggcucgaaucgcgagaauacacaaaacaccuaauccgcgucgagaacuggauauuccguaaccccggauucgcccuagcagccgccgcaaucgccuggcuacuaggcagcucaaccagccaaaaaguuaucuaccuugucaugauacuccucauugcgccagcauacucgaucagauguauuggugucaguaaccgcgacuucguagaaggcauguccggcggaacaugggucgacgucguucucgaacacgggggaugcgucaccgucauggcacaagacaaaccaaccgucgacauagaacucguaacuacaaccgucuccaacauggccgaaguccgcagcuacugcuacgaagccagcaucucagacauggcgagcgauucccgcugccccacgcaaggcgaagccuaccuagacaaacaaagcgacacccaauacguauguaaacggacccucgucgacagaggauggggcaacggcugcggccuuuucggcaaaggcagccuaguaaccugcgccaaauucgccugcagcaaaaaaaugaccggaaaaagcauucaaccugaaaaccuagaguaccgcaucaugcucuccguccacggaucgcaacacuccggcaugauagucaaugacaccggacacgaaaccgacgaaaaccgugcgaaaguggaaaucaccccuaauagccccagggccgaagccacacucggcggauucggcagccuagggcuagacugcgaacccagaacaggccuagacuucagcgaccuauacuaccucacaaugaacaacaaacacuggcuaguccacaaagaaugguuccacgacaucccacuaccauggcacgcuggagccgacacagggacuccccacuggaacaacaaagaagcgcucguagaguucaaagaugcacacgcaaaacggcaaacagucguaguccuaggcucacaggaaggcgcgguccauacagcccucgcaggagcacucgaagcagaaauggacggagccaaaggccgacuaagcagcgggcaccucaaaugcagacucaaaauggacaaacucagacugaaaggcguaagcuacagccuuugcacagcagccuucaccuuuaccaaaauacccgccgaaacccuacacggcaccguaacgguagaaguucaauacgcaggcaccgacggaccaugcaagguccccgcacaaauggccgucgauaugcagacccuaacccccgucggacgccucaucaccgccaacccagucauaaccgaaagcacagaaaacucgaaaaugaugcucgaacuagacccacccuucggagacucauacaucguaaucggagucggagaaaaaaaaauaacacaucacuggcaccgauccggcucaacaauaggcaaagccuucgaagcaacaguacgaggagcgaaacggauggccguacucggagacacagccugggacuucggcagcgucggaggagcccucaacagcuuaggaaaaggcauccaccaaauauucggagccgcauucaagucccuguucggcggcauguccugguucagccaaauacuaauaggcacgcuacugauguggcucggacucaacaccaaaaacggcagcaucagccucaugugccucgcgcucggaggcguccucauauuccuuucaaccgcagucucagcg

SEQ ID NO: 2971 - RNA, 2061 nt, Artificial Sequence
  KU744693.1 prME-short CDS opt
acaagcgucgggaucgugggccuccuacuaacgaccgcaauggcagcagaggucacccgcagaggaagcgcauacuacauguaccuagaccgaaacgacgccggagaagcaaucagcuuccccacaacccucggcaugaacaaaugcuacauacagaucauggaccuaggacacaugugcgacgccaccaugagcuacgaaugcccgaugcuagacgaaggcgucgaaccagacgacgucgacugcuggugcaacacaacaagcacauggguagucuacggaaccugccaccauaagaaaggcgaagcgcgcagaagccggcgagcaguaacccuaccaagccacuccacaagaaaacuacaaaccagaucacagaccuggcucgaaagccgggaauacaccaaacaccucauccgcgucgaaaacuggaucuucagaaaucccggcuucgcccuagcggcagccgccaucgccuggcuauuaggcagcaguaccucccagaaaguaauauacuuagucaugauacuacuaauagcgccagcguacucgauacgaugcauaggagucagcaaccgagacuucgucgaaggcaugagcggagggacguggguggacguaguacucgaacacggaggcugcgucacggcgauggcucaagacaaacccacagucgacaucgagcuagucaccacaaccguaagcaacauggccgagguaagaucauacugcuacgaggcauccauaagcgacauggcaagugacucaagaugccccacacaaggagaagcauaccucgacaaacaguccgacacccaauacgucuguaaaagaacccuaguagacagaggcuggggcaacgggugcggacuauucggcaaaggcagccucgugacaugcgcgaaauucgcuugcuccaagaaaaugacaggcaaauccauccaacccgaaaaccucgaauaccgcauaaugcuaagcguacacgggucccaacacuccggcaugcuggugaacgauaccggacacgagaccgacgaaaacagagcgaaaguagaaauaaccccaaauagcccgcgagcagaagcaacucuaggcggauucggcagccuuggacuagacugcgaaccaagaacaggccucgacuucucagaccuauacuaccucaccaugaacaacaaacacuggcucgcgcacaaagaaugguuccacgauaucccccuccccuggcacgcaggcgcagcaacgggaacaccacacuggaacaacaaagaagcccucgucgaguucaaagacgcgcacgccaaaaggcaaaccgucguaguacuaggaucccaagaaggagccguccacaccgcacucgccggagcacuagaagccgagauggacggcgcaaaaggacgacucuccagcggccaccucaaaugccgacucaaaauggacaaacugcgccuuaaaggcgucucguacuccuuaugcacggccgccuucaccuuuacaaaaauacccgcagagaccguagacggcaccgucaccguagaagggcaguacgggggaaccgauggaccuugcaaaguaccagcccaaauggcaguagacaugcagacccuuacacccguaggacgacuaauaacagccaaccccgucauaaccgaauccaccgaaaacagcaaaaugaugcuagaacuagaucccccauucggcgacucauacaucgugaucggggucggagaaaagaaaauaacccaccacuggcacaggagcgggagcacaaucggcaaagccuucgaagccaccguacggggcgccaaacgaauggccguucucggcgacacagcaugggacuucggcucggucggcggagcacuaaacagccucggaaaaggaauacaccaaauaauaggcgcggccuucaaaucacuauucgggggcaugagcugguucagccaaauacugauagggacgcugcugauguggcucggacugaauacgaaaaacggcuccaucagucuaaugugccuagcccuaggaggcguacugauauuccucagcacagcaguauccggc

SEQ ID NO: 2972 - RNA, 2052 nt, Artificial Sequence
  KU963574.2 prME-short CDS opt
ggcgccgacgccagcaucggcaucgucucccuacuccuaacaaccguaauggcagcagagauaacgcgacgaggauccgcguacuacauguaccuagacagaagcgacgccggcaaggccaucucauucgucacaacgcuaggcgucaacaaaugccacguucaaauaauggaucucggccacaugugugacgcuaccaugagcuacgaaugcccaaugcucgacgagggcgucgaacccgacgacguggacugcuggugcaacaccaccucaacaugggucguauauggcacgugccaccacaagaaaggcgaagcccgccgaucaaggagagccgucacccucccaagccacucaaccagaaaacuccaaaccagaagccagaccuggcucgagagccgagaauacacaaaacaccugauaaaaguagaaaacuggaucuuccgaaacccaggcuucgcgcuagucgcaguagccauagccuggcuccucggcagcuccacaucacagaagguuauauaccuagucaugauacuccucaucgccccagcauacagcauccgcugcauaggcguaagcaaccgcgacuucgucgaggggauguccggaggaacgugggucgacguagugcuagaacacgguggcugcguaaccgucauggcgcaagacaaaccgaccgucgacaucgagcuagucacaacgacaguaucaaacauggccgaaguacgaagcuacugcuacgaagccagcaucagcgacauggccucagacagcagauguccaacccaaggagaagcauaccucgacaaacaaagcgacacgcaauacgucugcaaacgcacccuaguagaccguggauggggcaacggcugcggccuguuuggaaaaggcucacuggucacaugugccaaauuuacaugcagcaagaaaaugacgggcaaaagcauacaaccagaaaaccuagaauaccgcaucaugcuaagcguccacggaagccaacacuccggaaugauagucaacgacgaaaaccgagcaaaagucgaaguaacacccaacucaccaagagcagaagcaacacucggcggcuucggaagccugggccuagacugcgaacccagaaccggacuagacuucagcgaccuguacuaccucaccaugaacaacaaacacuggcucguccacaaggaaugguuccacgacauaccacuaccauggcacucaggagccgacaccgaaaccccacacuggaacaacaaagaagcacugguggaauuuaaagacgcacacgccaaaagacagaccgucguaguccucgggagccaagaaggcgccguccauacagcacuggccggagcccuagaggccgaaauggacggagcaaaaggacgccuaucauccggccaccucaaaugccgccucaaaauggacaaacuccgacuaaaaggcguauccuacucccugugcaccgccgcauucacauucacaaaaguaccagccgaaacacugcacggcacggugaccguagaaguccaauacgcaggacgcgacggcccaugcaagguccccgcacaaauggcaguagacaugcagacauuaacgccagucggaagacucauaaccgccaaccccgucauaacugaaagcaccgaaaacucaaaaaugaugcuugaacuagacccacccuucggagacuccuauaucgucauaggaguaggcgacaagaaaauaacacaccacuggcacagaucaggcagcauaaucgggaaagccuucgaggccacaguccgcggcgccaaacgcauggcaguccuaggggacacagcaugggacuucggcuccgugggcggaguuuucaacucccuaggaaagggaauccaccaaaucuucggcgccgccuucaaaucacucuucggaggaauguccugguucucucaaauccuaaucggaacccuacucgucuggcucggccuaaacaccaagaacggcagcauaagccuaaccugccucgcgcucggaggcguaaugauauuccucucaacugcggucagcgca

SEQ ID NO: 2973 - RNA, 2070 nt, Artificial Sequence
  KF383120.1 prME-short CDS opt
ggagcagacaccagcaucggaaucauaggacuacuccuaacaacagcuauggcggccgaaaucacgagaagaggaagcgcauacuauauguaccucgaccguuccgacgcaggcaaagcgauaucauucgcaaccacaaugggcgugaacaaaugccacguccaaaucauggaccuaggucacaugugugacgccaccaugucuuacgaaugccccaugcucgacgaaggagucgaacccgacgacguagacugcuggugcaacaccaccuccacauggguuguguacggaacaugccaucacaagaaaggagaagcccggccgucccgccgcgcaguaacgcucccgagccacuccaccagaaaacuacaaacccgcucacaaacauggcucgaaagucgcgaguacacaaaacaucucauaaaagucgaaaacuggauacuacgcaacccaggcuucacaguggccgcgcucgccauggccuggcuacugggaaacaguacgagccagcgcguaaucuaccucguaaugauucuccugaucgcacccgcauacuccauacgcugcaucggcguuagcaaccgcgacuucguagaaggaauguccggaggaaccuggguagacgugguccuagaacacggaggaugcgucaccgucauggcccaagacaaaccaacagucgacauagagcuaguaacaaccacggucuccaacauggccgaagucagaagcuacugcuacgaagcauccaucagcgacauggcaagcgacucccgcugucccacacaaggggaagccuaccucgacaaacaguccgacacacaauacgucugcaaacgaacccucguggaucgcggauggggcaacggaugcggacucuucggaaaaggaagccuagugaccugugcaaaguucacgugcuccaagaaaaugacaggaaaauccauacaacccgaaaaccucgaauaccggaucaugcucagcguccacggaucccagcacagcggaaugauagugaacgacauaggccacgaaaccgacgaaaaccgagcaaaaguggaagucaccccuaauucaccccgcgcagaagcaacacugggcggcuucggcagccucggccuagacugcgaaccgcgcaccggacuagacuuuucagaccuguacuaucuaacaaugaacaacaaacacuggcuuguccauaaagaaugguuccacgacaucccccucccauggcaugcaggcgcagacacaggcacaccccacuggaacaacaaagaggcacucguggaguucaaagacgcacacgccaaaagacaaaccgucguaguacucggcucccaagaaggagcaguccacaccgcucuggcaggagcauuggaggcagaaauggacggcgcgaagggccgacucuucucaggacaccucaaaugccggauaaaaauggacaaacuaaggcuaaaaggcgucagcuacucacucugcaccgccgcauucacauucagcaaagucccggcagaaacgcuccacggaacagucacgguggaggugcaauacgccggccgagacggacccugcaaaguccccgcccaaauggcaguagacaugcaaacgcucacccccguaggaagacuuaucacggccaacccaauaauaacagaauccaccgaaaacagcagaaugaugcucgagcucgacccucccuucggcgacucauacauaguuaucggaguaggcgacaagaaaaucacgcaccacuggcacaggucaggcagcacaaucggaaaagccuucgaagccaccguccgcggcgcaaaaagaauggccguacucggcgacacagccugggacuuuggaagcgucggcggagucuucaacucacuagggaaaggaguucaccaaguauucggagccgccuucaaaucgcuauucggcgggauguccugguucucgcaaauccucaucggaacccuucuagucuggcucggacugaacaccaaaaacggaagcaucucccuagcaugccuagcccucggcggugcaaugauauuccuaagcacggccguaagcgcc

SEQ ID NO: 2974 - RNA, 1353 nt, Artificial Sequence
  KU321639.1 solE CDS opt
ucgcaaaaggucauauaccuggucaugaucuuacucauagccccggcauacagcauaagauguauaggagucucgaacagagacuucgucgaaggaaugagcggaggcacguggguggacauaguccuggaacacggaggaugcgugaccgugauggcgcaagacaaaccgaccguggacauagaacugguaacaaccacggucucgaacauggccgaggucaggagcuacugcuacgaagcaagcauaagcgacauggcaagcgauaguagaugcccgacacaaggcgaggcauaucuagacaaacaaagcgauacccaauacguauguaagcgcacauuaguggaccgaggauggggaaacggcugcggacuguucgggaaaggaagccuagucacgugugcgaaguucgcgugcagcaagaaaaugaccggcaaaucgauacaacccgagaaccuagaauacagaauaaugcuaagcguacacgggagccagcacucgggcaugaucguaaacgacaccggacacgagaccgacgaaaaccgagcgaaaguggaaauaacacccaacucgccccgagcagaggccacccuaggaggauucggcucgcucgggcuagacugcgagcccaggacuggucuagacuucucagacuuguacuaccucacgaugaacaacaagcacuggcuaguacacaaggaaugguuccacgacauaccacugcccuggcacgcgggagccgacacagguacaccccacuggaauaacaaggaggcccucguggaguucaaagacgcccacgcaaaacgccaaaccgugguaguacucggcagccaggaaggggccguccacacggcccuggcaggggcacuggaagcggaaauggacggggcaaagggcagacuaucgagcggacaccuaaaaugucgccuaaaaauggacaagcuaaggcucaagggcguaaguuacagccuaugcacggccgcauucacguucacgaaaauacccgcagaaacgcuacacggcacggucacggucgagguccaauacgcgggcacagacggacccugcaaagugcccgcgcaaauggccguggacaugcaaacgcucacgcccgucggacggcucauaaccgcaaacccgguaauaaccgaaaguacggaaaacagcaaaaugaugcucgaguuagacccaccauucggggacucauacauaguaauaggcgugggcgagaaaaagauaacgcaccacuggcaccgcucgggaucuaccaucggcaaggcuuuugaagcaacaguacgcggggcaaaacgcauggccgugcucggggacacggccugggacuuuggcucg

SEQ ID NO: 2975 - RNA, 1353 nt, Artificial Sequence
  KU312312.1 solE CDS opt
ucgcaaaaagucaucuaccuagucaugauccuacucauagcccccgccuacagcauccgcugcaucggagucucaaaccgcgacuucguugaaggcaugucaggaggcacaugggucgacgugguacuagaacacggcgggugcgucacagucauggcccaagacaaacccacaguggacaucgaacuggucaccaccacaguaucaaacauggcagaaguuagaagcuacugcuacgaggcaagcauauccgacauggccagcgacucaagaugcccaacacaaggcgaagccuaccuggacaaacaaagcgacacucaauacguaugcaaacgaacgcuaguggacagaggauggggaaacggauguggccucuucggcaaaggcagccucgucacaugcgcaaaauucgccugcucaaagaaaaugaccggaaaauccauucaacccgagaaccuagaauacagaaucaugcuauccgugcacggcagccaacacuccggaaugauagucaacgacaccggccacgaaaccgacgaaaaccgcgcaaaaguggaaauaaccccaaacucacccagagccgaagcaacacuaggcggcuucggcucccucggacuagacugcgaacccagaaccggccucgacuucucagaccuauacuaucuaaccaugaacaacaaacacuggcucgugcacaaagaaugguuccacgacauaccccuacccuggcacgcaggggccgauacaggcacaccccacuggaauaacaaagaagcccucguagaguucaaagaugcacaugcaaaacgacagaccguagucgugcucggcagucaggaaggcgccguccacacggcccuggccggagcccucgaagcagaaauggacggcgcaaaaggccgacucuccagcggacaccuaaaaugccgccuaaaaauggacaaacuacgccucaaaggcgucagcuacagccucugcacagcagcauucacguucacaaaaauaccagcagaaacacuccacggcacaguaacagucgaaguccaguacgccggcacagacggacccugcaaaguaccagcacaaauggcaguagacaugcaaacgcucacgcccguaggacgccuaaucaccgcaaauccagucaucaccgaaagcaccgaaaacagcaaaaugaugcucgaacucgaucccccauucggcgacucguacauagucaucggcgugggagaaaagaaaaucacacaccacuggcaccgcuccggaagcaccauaggcaaagccuucgaagccaccguacgcggagccaaacgcauggcaguacucggagacacagccugggacuucggcucc

SEQ ID NO: 2976 - RNA, 1341 nt, Artificial Sequence
  AY632535.2 solE CDS opt
ucgcaaaaaguaauauaccuagucaugauccuacucaucgccccagcuuacagcauacgcugcaucggggucucaaacagggacuucgucgaaggcaugagcggaggaacauggguggacgugguacuagaacacggcggaugcguaaccguaauggcgcaagacaagccuaccguagacaucgaacuaguaaccaccacagucuccaacauggccgaagucaggaguuacugcuacgaagcaagcauaagcgacauggcgagcgacagccggugcccgacacaaggugaagcauaccuagacaaacaaagugacacccaauacgucugcaaaaggacccuaguagacaggggcuggggcaacggcugcggucuauucggaaaaggcagccuagucacaugcgccaaauucaccugcagcaaaaaaaugaccggcaaaucaauccaacccgaaaaccucgaauaccgcauaaugcugagcgugcacgggucacaacacucgggaaugaucggauacgaaacagacgaagaccgcgcaaaaguagaaguaacaccgaacucgccaagagcagaagccacccucggaggauucggcucucucggacucgacugugaaccaagaaccgggcuagacuucucagaccucuacuaccuaacgaugaacaacaaacacuggcucgugcacaaagaaugguuccacgacauaccccugcccuggcacgcaggcgcagacacgggcaccccacacuggaacaacaaggaagcacuaguagaauucaaagacgcccacgccaagcgucaaacaguagucgugcucgggagccaagaaggggccguacacacggcccuagcaggggcccuagaagcagaaauggacggggcaaaaggaagacuauucuccggacaccugaaaugccgccuaaaaauggacaaacucagacuaaagggcguaagcuacagccuaugcacagccgcauucacauucacaaaaguccccgcagaaacacuacacggcaccgucaccgucgaaguccaauacgcgggcacagacggcccauguaaaauaccaguacaaauggcaguagacaugcaaacacucacgccggugggcagacucauaacagcaaacccagucauaaccgaaagcacagaaaacaguaaaaugaugcuugaacucgacccacccuucggugacucguacaucgucauaggaguaggcgacaaaaaaaucacgcaccacuggcaccgaucagggucaaccauuggcaaagcauucgaagcaacaguacgcggggccaaacgcauggccguccuaggggacaccgccugggacuucggauca

SEQ ID NO: 2977 - RNA, 1353 nt, Artificial Sequence
  KU527068.1 solE CDS opt
ucccaaaaaguaauauaccuaguaaugauccuccucaucgcaccggccuauaguauccguugcauaggagucagcaacagagacuuuguagaaggcaugagcggcggcaccugggucgacgucguccuggaacacggaggaugcgugaccguaauggcacaagacaaaccgaccguggacaucgaacuggucacaacaacagucucaaacauggccgaagucagaagcuacugcuacgaagcaagcauaagcgacauggcgagcgacagccgaugcccaacccagggagaagcauaccucgacaaacagagcgacacacaauacguaugcaaacgaacgcucguagacaggggcuggggcaacggaugcggccuauucggaaaagggagccuagucacgugcgcgaaauucgccugcagcaagaaaaugacaggaaaaucaauccagccagaaaaccuagaguaccgaaucaugcugagcguacacgggagccaacacucaggcaugaucguaaacgacaccggacacgaaaccgacgaaaaccgcgcaaaaguagaaauaaccccaaacucaccaagggccgaagcaacgcuaggcggauucggcucacucggacucgacugcgagccaagaaccggacucgacuucagugaccuguacuaccucacaaugaacaacaaacacuggcuaguacacaaagaaugguuccacgacauaccacuccccuggcacgcgggcgcagacacgggcacaccacacuggaacaacaaagaagcccucguagaguucaaagacgcacacgccaaacgacagaccgugguaguacucggaagccaggaaggggccgugcacaccgcccuggccggcgcccuggaagccgaaauggacggagcaaaaggccgccucucaagcgggcacuuaaaaugucgccuaaaaauggacaaacucagguuaaaaggcguaagcuacagucuaugcacggccgcauucacauucaccaaaauaccagcggaaacgcuacacggcacagucacggucgaaguccaauacgcgggcacagacgggcccuguaaaguaccagcacaaauggccguagacaugcaaacacuaacaccggucggccgacucauaaccgcgaacccagucauaaccgaaagcacagaaaacaguaagaugaugcuagaacuagaucccccauucggagacagcuacauagucauaggcguaggugagaaaaagauaacacaccacuggcacagaagcggaucaaccauaggaaaggccuucgaagcaaccgugagaggggcaaaaagaauggccguacucggcgacaccgccugggacuucggcucg

SEQ ID NO: 2978 - RNA, 1353 nt, Artificial Sequence
  KX421193.1 solE CDS opt
ucgcaaaaaguaaucuaccuagucaugaucuugcuaauagccccggccuacagcauacgcugcaucggaguaucaaacagggacuucgucgaaggaaugagcggaggcacguggguagacgugguacuagaacacggcggaugcgucaccguaauggcgcaagacaaaccaaccguggacaucgaacucguaacgaccacgguaucaaacauggccgaaguaagaagcuacugcuacgaagcaagcaucagcgacauggcaagcgauagccggugcccgacccaaggagaagcauaccuagacaaacagagcgacacccaauacguaugcaaacgaacccuaguagacaggggcuggggcaacggcugcggacuauucggaaaagggagccuagucacaugcgccaaauucacaugcagcaagaaaaugaccgggaaaucaauccagcccgaaaaccuagaauaccgcauaaugcuaagcgugcacgggagucagcacucuggcaugaucgugaacgacacgggauacgaaacagacgaaaacagagcaaaaguagaaguaacaccaaacuccccaagagccgaagccacgcucgggggauucggaucgcucggacuagacugcgaaccccguaccgggcuagacuucucagaccuauacuaccuaacaaugaacaacaaacacuggcucguacacaaagaaugguuccacgacauaccacugcccuggcacgcgggcgccgacacuggaacaccacacuggaacaacaaagaagcccuaguagaguucaaagacgcacaugcaaagagacagaccguggucguacugggaagccaagaaggagcaguacacacagcacuagcaggggcacuagaagcggaaauggacggggccaaaggaaaacuauucaguggacacuuaaagugcagacuaaaaauggacaaacuaagacucaagggcguaagcuacagccuaugcacagcagcguucacguucacgaaagugccagcggaaacgcuacacggaaccgucacugucgaaguccaauacgcgggcacagacgggcccugcaaaauccccguccaaauggccguagacaugcaaacgcuaacacccgugggaagacuaauaaccgcaaacccagucauaacagaaagcacggaaaauagcaaaaugaugcucgaacuagacccaccguucggagacagcuacauaguaauaggcguaggagacaagaaaaucacccaccacuggcaccgcucgggcucaaccauaggaaaagccuucgaagcgaccguacgcggagccaaacgaauggccguacuaggagacacggcaugggacuucggcucg

SEQ ID NO: 2979 - RNA, 1353 nt, Artificial Sequence
  LC002520.1 solE CDS opt
ucacagaaaguaauauaccuaguaaugauacuccucauagccccggccuacuccauacgcugcaucggagucagcaacagagacuucguagagggaaugagcggcggaacauggguagacgugguccuagaacacggcggaugcguaacaguaauggcacaagacaaaccaaccguggacauagaauuggucacaaccacaguaucgaacauggccgaagucagaaguuacugcuacgaagcaagcauaagcgacauggcaagcgacagccgcugccccacccaaggagaggcauaccucgacaaacaaagcgacacacaauacguaugcaaacgaacacucguagaccggggcugggguaacggcugcggccuauucgggaaagggagccuagucacaugcgcgaaguucacaugcagcaagaaaaugaccggcaaaagcauccagcccgagaaccuagaauacagaauaaugcucagcgugcacgggagccaacacucgggcaugaccguaaacgacaucggcuacgaaacagacgaaaaccgcgccaaaguagaaguaaccccgaacucgccaagagccgaagccacccuagguggauucggaucccucggacucgacugcgaaccaagaaccggacucgacuucucggaccuauacuaccucacgaugaacaacaaacacuggcuaguacacaaagaaugguuccacgacauaccccuacccuggcacgccggagcagacacaggcacgccacacuggaacaacaaagaagcgcuaguagaguucaaagacgcccacgccaaacgacaaacagugguaguguuaggaagccaagaaggggcaguccacacagcccuggcaggagcacucgaagcagaaauggacggagccaaaggcaaacucuuuagcggacaccucaaaugccgccuaaaaauggacaaacuccgccuaaagggcguaaguuacagccugugcacggcagcguucaccuucacaaaagugcccgcggaaacacuccacggcaccgucacggucgaaguccaauacgcaggaacggacggacccugcaagauacccguacaaauggcaguagauaugcagacucucacccccgucggaagacucauaaccgccaacccgguaauaacagaaagcacagaaaacagcaaaaugaugcucgaacucgacccaccauucggggacucauacauagugaucggcgugggcgacaagaaaaucacccaccacuggcaucgcucgggcagcaccauaggcaaagccuucgaagcaacaguccgcggggcaaaacgaauggccguauuaggggacaccgcaugggacuucggcucg

SEQ ID NO: 2980 - RNA, 1335 nt, Artificial Sequence
  DQ859059.1 solE CDS opt
ucccaaaaggucauauaccuuguaaugauccuacucauagcuccagcauacagcauacgcugcauaggcguaucaaacagagacuucguagaaggcaugagcggaggaacaugggucgacguaguacucgaacacggaggcugcgucacaguaauggcacaggacaaaccgaccguggacauagaacucgucacaaccacagucuccaacauggccgaaguaagaagcuacugcuacgaagcaagcaucagcgacauggcgucagacagccgaugcccaacacaaggcgaagccuaccuggacaaacagagugacacccaguacgugugcaaacggacacuuguagacagaggcuggggcaacggcuguggccuguucggaaaagggagccuagugaccugcgcaaaauucacaugcagcaagaaaaugacaggcaaaucaauccaaccagaaaaccucgaauacagaauaauguuauccguccacggaagccaacacuccggcaugauaguaaacgacgaaaaccgcgccaaaguagaaguaacaccaaacucacccagagccgaagccacgcucggcggcuucggaucgcuaggccuagacugcgaaccccgaacagggcucgacuucagcgaccucuacuaccucacgaugaacaacaaacacuggcuaguacacaaagaaugguuccacgacaucccccuacccuggcacgcaggcgcagauacaggcacaccgcacuggaacaacaaggaagcgcucguggaguucaaagacgcacacgccaagagacaaaccguagucguacuaggaagucaggaaggcgccguacacaccgcccucgccggagcacucgaagcagaaauggacggagcaaaaggaagacucuucagcggacaccucaaaugccgccucaaaauggacaagcuaagacucaaaggcguaagcuacagccuaugcacagccgccuucacauucacaaaaguacccgccgaaacacuccacggcacagucaccgucgaaguccaauacgccggcacagacggacccugcaaaguacccgcacaaauggccgucgacaugcaaacgcucacacccgucggcaggcucauaaccgcaaacccggucaucaccgaauccacggaaaacaguaaaaugaugcucgaacuagaucccccauucggcgacucguacauaguaauaggcgucggcgacaagaaaauuacacaccacuggcaccgauccggaagcaccauaggcaaagccuucgaagcaacaguccgcggcgccaaacgcauggccguacuaggggacacggcaugggacuuuggcucg

SEQ ID NO: 2981 - RNA, 1341 nt, Artificial Sequence
  KU963573.2 solE CDS opt
ucacaaaaagucauauaccuaguaaugauacugcuaauagcaccagcauauagcauacgcugcaucggagucuccaacagagacuucgucgagggcaugagcgggggaacguggguggacguaguacucgaacacggcggaugcgucaccgucauggcacaagacaaaccaacaguagacauagaacuggucacaaccaccgucucaaauauggccgaagucagauccuacugcuacgaagcaagcaucuccgacauggcaagcgacagccgaugcccaacccaaggcgaagccuaccucgacaaacaaucagacacgcaauacguuugcaaacgaacccucgucgaccgaggcuggggcaacggcugcggccucuuugggaaaggaagccuaguaacaugcgcgaaauucacaugcuccaagaaaaugaccggcaaaucaauccaaccagagaaccuagaauaccgaaucaugcugagcguacacggcagccaacacucaggaaugauaggguacgaaaccgacgaaaaucgagccaaagucgaagucaccccaaacagcccacgagccgaagccacccucggaggcuucggaucacucggacucgacugcgaaccccggaccgggcucgacuucucagaccuguacuaccucacaaugaacaauaaacacuggcucguacauaaagaaugguuucacgacauaccccuccccuggcacgccggcgcagacaccggcacaccacacuggaacaacaaagaagcacucguggaguucaaagacgcccacgccaaacgccagaccgucgucguacuaggcucacaagaaggagcaguccacacagcccuagcaggggccuuagaagcggaaauggacggcgcaaaagggaaacucuucagcggacaccugaaaugccgccuaaaaauggacaaacuacgacucaaaggcguaagcuacagucuaugcacggccgcauucaccuucaccaaagucccagcagaaacacuccacggcacagucacaguagagguucaauacgcaggcacagacggccccugcaaaauacccguccaaauggccguagacaugcaaacccuaacccccgucggcagacuaaucacagccaacccggucaucacagaauccacagaaaacagcaaaaugaugcucgaacucgacccaccauucggagacucuuacauagucauaggaguaggcgacaagaaaaucacgcaccacuggcaccgauccggcuccacaauaggcaaagccuucgaagcaaccgugcgcggcgcaaaaagaauggcaguccucggagacaccgccugggacuucggcuca

SEQ ID NO: 2982 - RNA, 1353 nt, Artificial Sequence
  KY075939.1 solE CDS opt
ucgcagaaagucauauaccuggucaugauccugcucauagccccagccuacagucuacgaugcaucggaguaagcaacagagacuucgucgaaggaaugaguggaggcacauggguggacgucguccuggaacacggcgggugcgucacaguaauggcacaagacaaacccaccguagacaucgagcuagucacaaccacagucuccaacauggccgaagucagaagcuacugcuacgaagcaagcauaucagacauggcaagcgacagcagaugcccgacccagggggaggccuaccucgacaaacaaagcgacacccaauacgucugcaaacgcacccuaguggacaggggcuggggcaauggcugcggccuguucggaaaaggcagccuggucacaugcgcaaaauucgccugcucaaagaaaaugacaggaaaaagcauccaacccgaaaaccuggaauaucgcauaaugcuaucaguccacggcagccagcacucaggcaugauagugaacgacaccggacacgaaacagacgaaaaccgcgcaaaaguagaaauaaccccaaacucaccccgagccgaagcaacgcuuggcggcuucggaucacuuggacucgacugcgaaccaagaaccggacuagacuucagugaccucuacuaccucaccaugaacaacaaacacuggcucgugcacaaagaaugguuccacgacauaccauuacccuggcacgcgggcgcagacacuggaacaccccacuggaacaacaaagaagcgcucguggaguucaaagaugcccacgccaaacgccagaccguggucguacucgggagccaggaaggagcaguacacacggcccuagcaggggcccuagaagcagaaauggacggagcaaaaggcagacucucaagcggacacuuaaaaugccgccugaaaauggacaaacuacggcuaaaaggaguaaguuacagccucugcacagccgcauucacguucacgaagauaccggccgaaacacuccacggaacagucacgguagaaguccaauacgcgggcacggacgggccaugcaaaguacccgcgcaaauggcaguagacaugcaaacgcuaacacccgugggccgacucauaacagcaaaccccgucauaaccgaaagcaccgaaaacagcaaaaugaugcucgaacucgaucccccguucggagacucauacauaguaauaggcguaggagaaaagaaaaucacgcaccacuggcaccgcucaggaucaaccauaggcaaagccuucgaagccacaguaagaggggccaaacgcauggcagugcuaggcgacacagccugggacuucggauca

SEQ ID NO: 2983 - RNA, 1353 nt, Artificial Sequence
  KX447516.1 solE CDS opt
agcaaaaaagucauauaccucgucaugauccuccuuauagcccccgccuacucaauccgcugcaucgguguaagcaaccgcgacuucguugaaggaauguccggcggaaccugggucgacgucguccucgaacacggcggcugcgugacugucauggcacaagacaaacccaccguagacaucgaacucgucacaaccaccgucucgaacauggccgagguacggagcuacugcuacgaagcauccauaucagacauggccuccgacuccagaugcccaacucaaggagaagccuaccucgacaaacaauccgacacccaauacguaugcaaacgaacccuaguggaccgaggauggggcaacggcugcggacucuucggcaaaggcucccucgugacaugcgccaaauucgccugcucaaaaaaaaugaccggaaaauccauccaacccgaaaaccucgaauacaggaucaugcuaagcguccacggaucacaacacuccggaaugaucgucaacgacacaggacacgaaacagacgaaaaccgagcaaaaguagaaauaacaccaaacucccccagagccgaagccacccucggcggcuucggcucccuaggccuagacugcgaaccaagaacgggccucgacuucuccgaccucuacuaccucaccaugaacaacaaacacuggcucguacacaaagaaugguuccacgauaucccccuccccuggcacgccggcgccgacaccgggaccccccacuggaacaacaaagaagccuuagucgaauucaaagacgcacacgcaaaaagacaaaccgucgucguccucggaagccaagaaggcgcaguccacacagcccucgcgggagcccuagaagcagaaauggacggagcgaaaggccgccucuccagcggccaccucaaaugccgccucaaaauggacaaacuaagacugaaaggcgucuccuacucccucuguaccgcagcauucaccuucacaaaaauccccgcagaaacccuccacggcaccgucaccguagaaguccaauacgcaggcacggacggccccugcaaaguaccagcccaaauggccguagacaugcaaacccuaacccccgucggccgacucauaaccgcaaauccagucaucacagaaucgaccgaaaacagcaaaaugaugcucgaacuugaccccccauucggggacuccuacauaguaaucggcgucggcgaaaaaaagauaacccaccacuggcaccgcucuggaucuaccaucggcaaagccuucgaagccaccguacgcggagcaaaacgcauggccguccucggcgacaccgcaugggacuucggaagc

SEQ ID NO: 2984 - RNA, 1353 nt, Artificial Sequence
  KX447515.1 solE CDS opt
ucacaaaaaguaaucuaccuggucaugauccuacucauagcccccgcauacagcauacgcugcauaggagucucaaaccgcgacuucgucgaaggaaugagcgggggaacguggguagacguaguccuagaacacggcggaugcguaaccguaauggcgcaagacaaaccaaccguagacauagagcuagucacaacaacagucucgaacauggcagaagucaggagcuacugcuacgaagcaaguauaagcgacauggccagcgauucccgaugcccgacacaaggagaagcauaccuagacaaacaaagcgacacacaauacguaugcaaacgcacccuaguagaccguggcuggggcaacgguugcggacuauucgggaaaggaagucuggucacaugcgcaaaauucgcaugcagcaagaaaaugaccggaaaaucgauacagcccgaaaaccuagaauaccgaauaaugcuaagcguacacgggagccaacacucgggaaugauaguaaacgacaccggacacgagaccgacgaaaacagagcaaaaguagaaauaacaccaaacucgccucgagccgaagcaacacucggaggcuucggaucacucggacucgacugcgagcccagaaccggccucgacuucucggaccuauacuaccucacaaugaacaacaaacacuggcucguacacaaagaaugguuccacgacauaccccugcccuggcacgcaggcgccgacacgggaacgccccacuggaacaacaaagaagcccuaguagaguucaaagacgcacacgccaaacgccaaaccguggucgugcucgggagccaagaaggagcagugcacacagcacuggccggagcccuggaagccgaaauggacggagcaaaaggaaggcucucaagcggacaccuaaaaugccgccugaaaauggacaaguuaaggcuaaaaggaguaucauacagccucugcacggccgcguucaccuucacaaaaauacccgcagaaacgcuacacggcaccgucacagucgaaguacaguacgcgggaaccgacggcccaugcaaaguacccgcacaaauggccguggacaugcaaacacuaacgccagugggcaggcuaauaaccgcaaacccagucauaacggaaagcacggaaaauagcaaaaugaugcucgaacucgacccaccguucggagacucguacauaguaauaggcguaggcgaaaagaaaauaacacaccacugguaccgcucgggcucaaccauaggcaaagcauucgaagcaaccgugcgaggcgccaaacgcauggcuguacucggagacacagcaugggacuucggcuca

SEQ ID NO: 2985 - RNA, 1353 nt, Artificial Sequence
  KU758874.1 solE CDS opt
agccaaaaagucauauaccuagucaugauccuacuaaucgccccagcauacucaauacgcugcaucggcgucagcaaucgagacuucgucgaaggcaugagcggcggcacaugggucgacguaguccucgaacacggcggcugcgucaccgucauggcccaagacaaaccaaccguagacauagaacucgucacaacaacagucucaaacauggccgaagucagaagcuacugcuacgaagccuccauaagcgacauggcauccgacucacgcugcccaacacaaggcgaagcauaccucgacaaacaguccgacacgcaauacguaugcaaacgcacccuaguagacaggggcugggggaacggaugcggcuuauucggcaaaggcagccucgucacaugcgcgaaauucgccugcuccaagaaaaugaccggcaaauccauacagccagagaaccuagaauaccgaauaaugcucuccguccacggaucacaacacagcggaaugaucguaaacgacaccggccacgagaccgacgaaaaccgcgccaaagucgaaaucacccccaacagcccacgagccgaggccacacucggaggcuucggcucgcuaggacucgacugugaaccuagaaccggccucgacuucucagaccucuacuaccuaacgaugaacaacaaacacuggcuagugcacaaagaaugguuccacgacauaccacugcccuggcacgcaggcgcagacaccggcacgccacacuggaacaacaaggaagcccuaguagaguucaaagacgcccacgccaagcgacaaaccgucguagugcucggcucccaagaaggagccguccacacagcucuagccggagcacuagaagcagaaauggacggagccaaaggaaaacucucaagcggccaccuaaaaugccgacucaaaauggacaaauuacgacuaaaaggcguauccuacucccuaugcacagccgcauucacauucacaaaaauucccgccgaaacgcuacacggcacagucacaguggaaguacaauacgccggcacagacggaccaugcaaaguaccagcccaaauggccgucgacaugcaaacgcugacacccgucggcagacucauaacagccaaccccgucauaaccgaaaguaccgaaaacucaaaaaugaugcucgaacucgacccaccauucggagacagcuacauagucaucggcgucggagaaaagaaaauaacccaccacuggcaccgaagcggcuccacaaucggaaaagccuucgaagccacaguacggggagccaaacguauggccguacucggcgauaccgcaugggacuucggcagc

SEQ ID NO: 2986 - RNA, 1353 nt, Artificial Sequence
  KU729218.1 solE CDS opt
ucacaaaaagucauauaucuagucaugauccugcuaauagccccagccuacagcauccgcugcaucggaguaucgaaccgcgacuucgucgaaggcaugagcggaggcaccuggguagacguaguccuagaacacggcggaugcguuaccguaauggcacaagacaagccaaccguagacaucgagcuagucaccaccaccguuuccaacauggcagaaguacgaagcuacugcuacgaagcaaguauaagcgacauggcguccgacagccggugccccacacaaggcgaagccuaccucgacaaacaaagcgacacacaguacguuugcaagcggacgcugguggaccgcggcuggggcaacggaugcggauuguucggaaaaggaagccuagucacaugcgcgaaauucgcaugcagcaagaaaaugacaggcaaaucaauacagccagaaaaccuagaauacagaauaaugcuaagcguacacggaagucaacacagcggcaugaucgucaacgacacaggccacgagaccgacgaaaacagagcaaaaguagaaauaaccccaaacucgccaagagccgaagccacacucggaggauucggcucgcucggacucgacugcgagcccagaaccggacucgacuucuccgaccuauacuaccucacaaugaacaauaaacacugguuaguacacaaagaaugguuccacgacaucccacugcccuggcacgcaggagccgacacaggcacaccccacuggaacaacaaggaagcucuaguagaguucaaagacgcccacgcgaaacgucaaaccguaguaguacuaggcagccaagaaggcgcagugcacacagcccucgccggcgcacuagaagcggaaauggacggcgcaaaaggcagauuaagcagcggccaccuaaaaugccgccuaaagauggacaaacuaagacucaaaggaguaagcuacagccuaugcacagcagcauucaccuucaccaaaauacccgccgaaacacuacacgggacaguaacagucgaaguacaguaugcaggcacagacggccccugcaaaguacccgcacaaauggccguggacacccaaacacuaacccccguaggcaggcuaauaaccgccaacccaguaaucaccgaaagcacagaaaacagcaaaaugaugcucgaacuagaucccccauucggagacuccuacaucgucauaggagucggcgaaaagaaaaucacucaucacuggcaccgaucaggcuccaccaucggcaaagcauucgaagcaaccguacgcggcgccaaacguauggccgugcuaggcgacacagccugggacuucggauca

SEQ ID NO: 2987 - RNA, 1353 nt, Artificial Sequence
  KU501217.1 solE CDS opt
ucacaaaaagucauauacuuagucaugauacuacucauugcccccgcauacuccauacgaugcaucggcgucuccaacagagacuucguagaaggcaugagcggcggcacaugggucgacguaguccuggaacacggcggcugcguaaccgugauggcccaagacaaaccaacuguagacauagaacucgucacaaccaccguaagcaacauggccgaaauccgaagcuacugcuacgaagccagcauaagcgacauggcguccgacagccgcugcccaacccaaggcgaagccuaccuagacaaacagagcgacacacaauacgucugcaaacgcacacuaguagacagaggcuggggaaacggcugcggacuauucggaaaaggaagccuaguaacgugcgcgaaauucgccugcagcaaaaaaaugacaggaaaaucaauccagcccgagaaccuagaauacagaauuaugcuaagcguacacgggucccaacacucaggaaugauaguaaacgacacuggccacgaaaccgacgaaaacagagccaaaguagaaauaacacccaacucaccccgagccgaagccacacuaggaggcuucggcucacucggacucgacugcgaaccaagaaccggacuagacuucucggaccucuacuaccucacgaugaauaacaaacacuggcucguccacaaagaaugguuccacgacauaccccucccuuggcacgcuggcgcagacaccggaacaccacacuggaacaacaaggaagcacucgucgaauucaaagacgcccacgccaaacgccaaaccguagucguacucggaucccaagaaggggcaguacacacagcccuggccggagcacucgaagcagaaauggacggcgccaaaggacgacuaucuaguggccaccugaaaugucgccuaaaaauggacaaacuccgacucaaaggcguaagcuacagccucugcaccgcagccuucaccuucaccaaaauaccagcagaaacacuacacggcacgguaaccgucgaaguccaguacgcaggaacugacgggcccugcaaagucccagcccaaauggcagucgacaugcaaacccuuacccccguaggacgccucauaacagccaacccagucaucaccgaaagcacagaaaacagcaaaaugaugcucgaacucgacccacccuucggagacucauacauagucauuggcgugggcgaaaaaaaaauaacucaccacuggcaccgaucgggcucaacuauaggcaaagccuucgaagcgaccguccgcggcgccaaacgcauggccguacucggcgacacagccugggacuucggcucc

SEQ ID NO: 2988 - RNA, 1353 nt, Artificial Sequence
  KU761561.1 solE CDS opt
agccaaaaaguaauauaccucgucaugauccugcucauagcccccgcuuacuccauacgcugcaucggcgucagcaacagggacuucguagaaggcaugucaggcggcacauggguagacguaguccuagaacacgggggaugcgucaccguaauggcccaagacaaaccaacaguagacaucgaacucgucacgacgaccgucuccaacauggccgaaguacgcagcuacugcuacgaagcaagcauaucagacauggcauccgacucccgcugccccacccaaggcgaagccuaccucgacaaacaauccgacacccaauacguaugcaaacgaacccuaguagaccgaggcuggggaaacggcugcggacuauucggaaaaggcucacucguaacaugcgcaaaauucgccugcagcaagaaaaugaccggaaaauccauccaacccgaaaaccucgaauaccgcauaaugcucuccguccacggaagccaacacucgggcaugaucguaaacgacaccggccacgaaaccgacgaaaaccgcgcaaaaguagaaauaacacccaacagccccagagcagaagcaacccucggcggcuuuggaucccucggacuagacugcgaaccccgaaccggccucgacuucagcgaucuauacuaccucacaaugaacaacaaacacuggcuaguccacaaagaaugguuccacgacauaccucugcccuggcacgccggugcagacacaggcaccccgcacuggaacaacaaagaagcccuagucgaguucaaagacgcccacgccaaacgccaaacagucgucguccuaggcagccaagaaggcgcaguccacaccgcccuagcaggagcccuagaagcagaaauggacggagcaaaaggaagauuaucauccggccaccugaaaugucgccuaaaaauggacaaacuccgacucaaaggggucagcuacagccucugcacggccgcauucacauucacaaaaaucccagcagaaacacuccacggaaccgucacaguagaaguccaauacgcaggcaccgacggccccugcaaaguaccagcacaaauggccguagacaugcaaacccuaacccccgucggacgccuuaucaccgcaaacccaguaaucacggaaucaaccgaaaacagcaaaaugaugcuagaacucgacccgcccuucggcgacagcuacauaguuauaggcguaggagaaaagaaaauaacccaccacuggcaucgcagcgguucaaccaucggaaaagccuucgaggccaccguacgcggcgcacgccgcauggccguacucggcgacacggccugggacuucggaagc

SEQ ID NO: 2989 - RNA, 1353 nt, Artificial Sequence
  KY075937.1 solE CDS opt
agccaaaaaguaauauaccuagucaugauacuacucaucgcacccgccuacucaauccgcugcauaggcgucucaaaccgagacuucgucgaaggcaugagcggaggaacgugggucgacguaguacucgaacacggcggaugcgugaccguuauggcacaagacaaaccaaccgucgacauagaacucgucacaacaacggucucaaacauggccgaaguccgcucauacugcuacgaagcauccauaagcgacaugguaucugacucacgcugcccaacccagggagaagcguaccuagacaaacaaagcgacacccaauacgucugcaaaagaacccuaguggaccgcggauggggaaacggcugcggccuauucggcaaaggaagccuaguaacaugcgccaaauucgccugcagcaagaaaaugaccggcaaaucaauacagcccgaaaaccuagaauacagaauaaugcuaagcguccacggcucacaacacuccggaaugaucguaaacgacaccggacaugaaaccgacgaaaaccgagcaaaagucgaaaucaccccaaacucacccagagccgaagccacccuaggaggauucggcagccuaggccuagacugcgaaccacgaaccggacucgacuucuccgaccucuacuaccuaacaaugaacaacaaacacuggcucguccacaaagaaugguuccacgacaucccccuccccuggcacgcaggagcagacaccggcacaccccacuggaacaacaaagaagcgcucgucgaguucaaagacgcacacgccaaacgccaaaccgucgucguacuaggaagucaagaaggcgccguacacaccgcacucgcaggcgcacuagaagcagaaauggacggagccaaaggccgacucagcagcggacaccucaaaugccgacuaaaaauggacaagcuacgccucaaaggagucuccuacagccuaugcacagcagcguuuacauucacgaaaaucccagcagaaacccuccacggcacagucacggucgaaguacaauacgcaggcacagacggacccugcaaaguccccgcgcaaauggccguagacaugcaaacccugaccccaguaggccgccuuaucaccgccaacccagucaucaccgaauccacagaaaacuccaaaaugaugcucgaacuagaucccccguucggagacuccuacauaguaauaggcguaggagaaaagaaaaucacccaccacuggcacagaucgggcuccacaaucggcaaagcauucgaagcaaccguccgaggcgccaaacgcauggccguacucggagacacggcaugggacuucggcuca

SEQ ID NO: 2990 - RNA, 1353 nt, Artificial Sequence
  KY014317.1 solE CDS opt
agccaaaaaguaauauaccucgucaugauccuucucaucgcaccagcauauuccauacgcugcauuggaguaucaaacagagacuucgucgaaggaaugagcggaggcacguggguggacgugguccuagaacacgggggcugcguaaccguaauggcucaagacaaaccgacaguagacaucgagcuagucaccaccaccgucucaaacauggcagaagucagaaguuacugcuacgaagccagcauaagcgacauggcaagcgacagcagaugccccacccaaggcgaggcauaccucgacaaacaaagcgacacccaauacguaugcaaacgcacacucguagaccgcggcuggggcaacggcugcggacuauucggcaaaggaagccucgucacaugcgccaaauucgcaugcucaaagaaaaugaccggcaaaagcauacagcccgagaaccuggaauaccgaauaaugcucagcguacacggaucacaacacucaggcaugaucgugaacgacacagggcaugaaaccgacgaaaaccgcgccaaaguagaaaucaccccgaacuccccaagagccgaagccacacucggcggcuucggcucacuaggacucgacugcgagccaagaaccggccuagacuucucagaccuuuacuaccucacaaugaauaacaaacacuggcucguccacaaagaaugguuccacgacauaccccuccccuggcacgcaggcgcagauacaggaacgccccacuggaacaacaaggaagcacuuguagaguucaaagacgcacacgccaaacgacaaaccguagucguacucggaagccaagaaggagccgugcacaccgcccuagcaggagcccucgaagccgaaauggacggagccaaaggcagacuaucaagcggacaccuaaaaugccgccuaaaaauggacaaacuacgacucaagggcguauccuacagccuaugcaccgcugcauuuaccuuuacaaaaauacccgccgaaacacuacacggcacaguaacagucgaaguccaguacgcaggcacagacgggcccugcaaaguaccagcacaaauggcaguagacaugcaaacgcuaacgcccguaggacgccucaucacagccaacccagucaucaccgaaagcauagaaaacagcaaaaugaugcuagaacuagaucccccauucggagacucauacauagucaucggcguaggagaaaagaaaaucacgcaccacuggcaccgcucaggaucaaccaucggcaaagccuuugaagcaacagugcgaggcgccaaacgcauggccguacucggagacacagccugggacuucggcucc

SEQ ID NO: 2991 - RNA, 1353 nt, Artificial Sequence
  KU870645.1 solE CDS opt
ucgcaaaaaguaauauaccuagucaugauacugcucauagcaccagccuacaguauacgaugcaucggcgucagcaacagggacuucgucgaaggcaugagcggaggcacauggguugacgugguacuagaacacggcggaugcguaaccgugauggcacaagauaaaccaacgguagacaucgaacugguaacaacaacaguaagcaacauggccgaaguaaggagcuacugcuacgaagcaagcauaagcgacauggcaagcgacuccagaugcccaacacaaggcgaagccuaccucgacaaacaaagcgacacccaauacgucugcaaacgcacacucguagauagaggcuggggaaauggcugcggccuauucggaaaaggaagccucgucacgugcgcaaaauucgccugcagcaagaaaaugaccggcaaaucgauccaaccagaaaacuuagaauaucgaaucaugcugagcguacacgggagccaacacuccggaaugauagugaacgacacaggacacgaaaccgacgagaacagggcaaaaguagaaaucacaccaaacucaccccgggccgaagccacacucggaggauucggaagccucggacuagacugcgaaccaagaacaggacucgacuucagugaccuauacuaccucacaaugaacaacaaacacuggcucguacacaaagaaugguuccacgacaucccacugccauggcacgcgggcgcagacacaggcacaccccacuggaacaacaaagaagcccuaguagaguucaaagacgcacacgccaaacgccaaaccguagucguacuaggaagccaagaaggggccguacacacagcccuggccggggcacucgaagcagaaauggacggagcaaaaggcaggcucucgucaggacaucuaaaaugccgccuaaaaauggacaaacucaggcucaaaggcgugagcuacagccuguguacagcagcauucacauucacaaaaauacccgcagaaacacuccacggcacagucacgguagaaguacaauacgcaggcacagacggcccaugcaaaguacccgcgcagauggccgucgacaugcaaacacuaacacccguaggacgacuaauaaccgcaaacccggucauaaccgaaagcacggaaaauagcaaaaugaugcucgaacuagacccaccauucggcgauucauacaucgucaucggcauaggcgaaaagaaaaucacacaccacuggcaccgcucaggcucaacaauaggcaaagccuuugaagcaaccguacgcggggcaaaacgcauggcagugcuaggggacacagcaugggacuucggcagc

SEQ ID NO: 2992 - RNA, 1353 nt, Artificial Sequence
  KU922923.1 solE CDS opt
ucacagaaagucaucuaccuagucaugauccuccuaaucgcacucgccuacucaauacgcugcauaggagucuccaaccgagacuucguagaaggaauguccggcggaaccuggguagacguaguccucgaacacgggggcugcguaacagucauggcccaagacaaacccaccgucgacauagaacucguaaccaccaccgucucaaacauggccgaaguccgaucguacugcuacgaagccagcaucuccgacauggccuccgacucccgaugcccaacccagggagaagccuaccuagacaaacaaagcgacacacaauacguaugcaaacgaacacucgucgaccgcggcuggggaaacgguugcggacuauucggcaaaggaagccuagucacaugcgcaaaauucgcaugcucaaagaaaaugaccggcaaauccauccaaccagaaaaccucgaauaccgaauaaugcucagcguccacggcucacaacacagcggaaugauaguaaacgacaccggacacgaaaccgacgaaaaccgcgcaaaagucgaaaucacccccaacuccccacgcgccgaagccacccuaggaggauucggaucccucggacuagacugcgaacccagaaccggccucgacuucuccgaccucuacuaccucaccaugaacaacaaacacugguuaguccacaaagaaugguuccacgacaucccccuccccuggcacgccggcgccgacacaggaaccccgcacuggaacaacaaagaagcccucgucgaguucaaagacgcgcacgccaaacgacaaaccgucgucguacuagggucccaagaaggagccguacacacagcacuagccggcgcccuugaagcagaaauggacggcgcuaaaggccgacucagcuccggacaccucaaaugcagacuuaaaauggacaaacuccgccucaaaggcgucagcuacagccucugcaccgccgcauucacauucacaaaaauacccgccgaaacccuccacggcaccgucacaguagaaguccaauacgccggaaccgacggccccugcaaaguaccagcccaaauggcagucgacaugcaaacacuaaccccagucggacgacuuaucacggcaaaccccgucaucacagaaucaaccgaaaacuccaaaaugaugcucgaacucgacccaccuuucggcgacuccuacaucguaaucggaguaggcgaaaagaaaaucacacaccacuggcaccgauccggauccacgaucggcaaagccuucgaagcaacaguccgcggagcaaaaagaauggccguacucggagauaccgccugggacuucggauca

SEQ ID NO: 2993 - RNA, 1353 nt, Artificial Sequence
  KU497555.1 solE CDS opt
agccaaaaagucauauaccuagucaugauccuccucauagccccagcauacuccauacgcugcaucggaguaagcaaccgagacuucgucgaaggaaugucaggcggaaccugggucgacgucguacuagaacacggcggaugcguaacaguaauggcccaagacaaaccaacaguagacaucgaacucguaacaaccacagucagcaacauggcagaaguaagauccuacugcuacgaagccucaauaagcgacauggcauccgacuccaggugcccaacacaaggcgaagccuaccucgacaaacaaagcgacacacaauacgucugcaaaagaacacuuguagacagaggauggggcaacggaugcggccucuucggaaaaggaagccucguaaccugcgccaaauucgccugcagcaaaaagaugacaggaaaaucgauccaacccgaaaaccuagaauaccgcaucaugcucuccguccacggcagccagcacucaggcaugauagucaacgacacaggacacgaaacagacgaaaaccgagccaagguagaaauaaccccaaacagcccccgagccgaagcaacccucggaggauucggaucacuaggacuagacugcgaaccccgaaccggccucgacuucuccgaccuauacuaccuaaccaugaacaacaaacacuggcucguccauaaggaaugguuccacgacauaccccugcccuggcacgcgggcgcagacacgggcacaccccacuggaacaacaaagaagcccucgucgaguucaaagacgcccacgcaaaacgccagaccguagucguacuaggcacccaagaaggagccguccacaccgcccuggccggagcccucgaagccgaaauggacggagcaaaagggcgacucagcagcggccaccuaaaaugccgccuaaaaauggacaaacuaagacuaaaaggcguaucauacagccuaugcacagcagcauucaccuucaccaaaaucccugcagaaacacuccacggcaccgucacggucgaaguccaguacgccggcacagacggacccugcaaagucccagcccaaauggccgucgacaugcaaacccuaacacccgucggaagacuaauaaccgccaaccccguaaucaccgaaagcacagaaaauucaaaaaugaugcucgaacuagaucccccguucggagacuccuacauaguuaucggcguaggcgagaaaaagaucacacaccacuggcacagauccggcagcacaauaggaaaggccuucgaagcaacaguccgcggagcaaaacgaauggcaguccucggagacacagccugggacuucggcuca

SEQ ID NO: 2994 - RNA, 1353 nt, Artificial Sequence
  KU312314.1 solE CDS opt
ucgcaaaaagucaucuaccuagucaugauccuccuaauagccccggccuacaguauacgaugcaucggcgucagcaacagggacuucgucgaaggcaugagcgggggcacguggguagacguaguuuuagaacacggcggaugcguaaccgugauggcacaagacaagccaaccguagacauagagcuagucacaaccacaguuucaaacauggcagaagucaggagcuacugcuacgaagcgagcauaagcgacauggcgagcgacagcagaugcccaacucaaggcgaagccuaccuugacaaacaaagcgacacccaguacguaugcaaaagaacccuagucgaccgaggaugggggaacgguugcggacuauucggaaaagggagccuagucacaugcgcgaaauucgccugcagcaaaaagaugacaggaaaaagcauccaacccgagaaccuagaauaucgaauaaugcucagcguacacgggagccaacacucaggaaugauagucaacgacacagggcacgaaaccgacgaaaaccgagcgaaaguggagauaacuccaaacucacccagagcugaggcaacacuaggaggcuucgggucacuuggacuagacugcgaacccagaacaggccucgacuucucggaccuauacuaccuaacaaugaacaacaaacacuggcucgugcacaaagaaugguuccacgacauaccacuaccuuggcacgcaggagcagacacagguacaccacacuggaacaacaaggaagcacucguagaguucaaagacgcacaugccaaacgacagaccguagucguacucgggagccaagaaggggccguacacacggcccuggcaggagcacuagaagcagaaauggacggagccaagggccgacucagcagcggccaccucaagugcagauugaaaauggacaagcuacgacucaaaggcguaagcuacagucuaugcaccgccgcauucacauucacaaaaaucccagcagaaacgcuacacggcacagucaccgucgaaguucaguacgccggaacagacggaccaugcaaagugcucgcccagauggcagucgacaugcaaacgcuaacgcccguagguaggcucauaaccgcgaacccgguaaucacagaaagcacagaaaacagcaaaaugaugcucgagcucgacccacccuucggagacagcuacaucgucauaggggugggagaaaagaaaaucacacaccacuggcaccgcagcgguucaaccaucggcaaagccuucgaagcgaccguacgaggagcuaaaagaauggccguacucggagacacagccugggacuucggcuca

SEQ ID NO: 2995 - RNA, 1353 nt, Artificial Sequence
  KY014314.1 solE CDS opt
agccagaaagucaucuaccuagucaugauccugcucauagcaccagcauacagcauaagauguaucggagucuccaacagagacuucgucgaaggaaugagcggaggaaccuggguagacguagucuuagaacacgguggcugcgucaccgugauggcacaagacaaaccgacaguagacauagaacucgucacaacaacaguaagcaacauggcagaaguacgaagcuacugcuacgaagcguccauaagcgacauggccagcgacagcagaugcccaacacaaggcgaagcauaccuagacaaacaauccgacacacaguacgucugcaaacgcacccuaguagacagaggguggggcaacggaugcggacuauucgggaaagggagccuagucacaugcgccaaauucgccugcucaaagaaaaugacaggaaaaagcauacaaccagaaaaccuagaauaccgaauaaugcuaagcguacacggaagccaacacagcggcaugaucguaaacgacaccggacacgaaacagacgaaaaccgagcaaaagucgaaauaacacccaacagcccccgagccgaggccacacuaggcgguuucggaagccucggacucgacugcgaaccacgcacagggcuagacuucuccgaccucuauuaccuaacaaugaacaacaaacacuggcucguccacaaagaaugguuccacgacauaccccuacccuggcacgcaggcgcggacacaggaaccccgcacuggaacaacaaagaagcccuagucgaguucaaagaagcccacgccaaacgacagacaguagucguccuaggaagccaagaaggagccguccacacagcccuagcaggagcacucgaagcagaaauggacggggccaaaggacgccuaagcuccggacaucuaaaaugccgccuaaaaauggacaaacucagacuaaaaggagucagcuacagccuaugcacagccgccuucaccuucaccaaaauaccggcagaaacacuccacggcacagucaccgucgaaguccaauacgcaggcaccgacggaccaugcaaaguacccgcacaaauggccguagacaugcaaacacuaaccccagugggacgacucauaacugccaacccagucaucaccgaaucaaccgaaaacagcaaaaugaugcuagagcucgacccaccauucggagacagcuacauagucaucggcgucggcgagaagaaaauuacgcaucacuggcacagaagcggcucgaccauaggcaaagccuucgaagcaacaguacgcggagcaaaacgaauggccguccucggagacacagccugggacuucggaagc

SEQ ID NO: 2996 - RNA, 1353 nt, Artificial Sequence
  KX447517.1 solE CDS opt
ucgcaaaaagucaucuaccuaguaaugauccugcuaauagcaccagccuacaguaucagaugcauaggagucucgaacagggacuucguagagggaaugucagggggcacguggguagacgugguacuagaacacggcggaugcgugaccgugauggcgcaagacaaaccgaccguagacauagaacucgucacgacaacggucucaaacauggccgaggucaggagcuacugcuacgaagcgaguauaagcgacauggcaagcgacagcagaugcccgacacagggcgaggccuaccucgacaaacagagcgacacccaauacgugugcaaacgcacccuaguggaccgaggcuggggcaacggcuguggccuguucgggaaggggagccucgucacaugcgcaaaauucgccugcagcaagaaaaugacaggaaaaagcauccagcccgaaaaccuggaauacagaauaauguuaagcgugcacggaagccagcacucaggcaugaucguaaacgacacaggccacgagaccgacgaaaaccgcgcaaaaguggaaauaaccccgaacucgccgagggcagaagccgcccuagggggauucggcucgcuagggcuagacugcgagccaagaacaggccuggacuucagcgaccuauacuaccuaacgaugaacaacaaacacuggcuagugcacaaggagugguuccacgacauacccuugcccuggcacgcgggagccgacacaggaacgccucacuggaauaacaaggaagcccuagucgaguucaaagacgcacacgcaaaacgacagaccguaguagugcuagggagccaggaaggggcagugcacacggcucuggccggagcacuggaagcggaaauggacggggccaaaggcaggcucucauccgggcaccugaaaugccgccugaagauggacaaacuaagacucaaaggcgucagcuauagccuaugcacggccgcguucacguucacgaaaauaccagccgaaacgcuacacggaacggucacgguagaaguccaguacgcgggcacggacgggccaugcaaagugccggcgcaaauggccguagacaugcaaacgcucacgccagugggaaggcuaauaaccgcgaacccaguaauaacagaaagcacagaaaauagcaagaugaugcucgagcucgaucccccguucggggacucauacauagucauaggcgugggcgagaaaaagauaacgcaccacuggcacagaucgggaucgaccauaggcaaagccuuugaagcgaccguacgcggggcaaaacgcauggcaguacucggggacacggcaugggacuuugguucg

SEQ ID NO: 2997 - RNA, 1353 nt, Artificial Sequence
  KU729217.2 solE CDS opt
ucccagaaagucauauaccucguaaugauccuacuaaucgcaccagcauacagcauaagaugcauaggcguuuccaaccgagacuucguagaaggcaugagcggcggcacauggguagacgucguccucgaacacggaggaugcguaaccgucauggcccaagacaaacccacagucgacaucgaacuggucucuacaacagucuccaacauggccgaaguccgaagcuacugcuacgaagcaaccauaucggacaucgcauccgacagccgcugcccgacacaaggcgaagccuaccucgacaagcaaagcgacacacaauacgucugcaaacgaacgcucgucgaccgaggcugggguaacggcugcggccucuucggcaaagggucccucguaacaugcgccaaauucgccugcucaaagaaaaugacaggcaaauccauccaaccagaaaaccucgaauacagaaucaugcuauccguacacggcagccaacacuccggcaugauuguaaacgacacaggccacgaaaccgacgaaaaccgagcaaaaguagaaaucaccccaaacagcccccgagcagaagccacccucggcggauucggaagccucggccucgacugcgaacccagaaccggacucgacuucagcgaccucuacuaccucaccaugaauaacaaacacuggcucguacacaaagaaugguuccacgacaucccccuacccuggcacgcaggcgccgacaccggaacaccccacuggaacaacaaagaagcacucgucgaguucaaagacgcccacgccaaacgccagaccgcagucguccucggaucacaggaaggcgccguccauacagcccuagccggcgcccuagaagcagaaauggacggcgcgaaaggccgccucagcagcggccaccuaaaaugccgccucaaaauggacaaacuacgccuuaaaggcgucagcuauagccucugcacagcugcauucaccuucacaaaaauccccgcagaaacccuacacggcacagucaccgucgaaguacaauacgccggcacagauggcccaugcaaagugcccgcccaaauggccguggacaugcaaacccucaccccagucggcagacucauaaccgccaacccaguaaucaccgaaucaaccgaaaacuccaaaaugaugcucgaacucgaucccccauuuggagacuccuacauagucaucggcguaggcgaaaagaaaaucacccaccacuggcaccgcagcggauccaccauaggcaaagccuucgaagccacaguccgaggagcaaaaagaauggccgugcucggagacacagcaugggacuucggcucc

SEQ ID NO: 2998 - RNA, 1353 nt, Artificial Sequence
  KY328290.1 solE CDS opt
ucacaaaaagucauauaccuagucaugauccuacuaauagcaccagcguauagcauacgcugcaucggaguaagcaacagggacuucgucgagggcaugagcggaggcacauggguggacgucguacuggaacacggaggaugcguaacagugauggcacaagacaaaccaaccguagacauagagcuaguaacaacaacagucucgaacauggccgaagucagaucauacugcuacgaagccagcauaagcgacauggcauccgacuccaggugcccaacccagggcgaagcauaccucgacaaacaaagcgacacacaguacguaugcaaaagaacccuaguggacagaggauggggcaacggaugcggacuauucggaaaagggagccucgucacaugcgcaaaauucgccugcagcaagaaaaugacagggaaaucaauacagccagaaaaccuagaauaccgaauaaugcucagcgugcacggaagccaacacucaggcaugaucguaaacgacaccgggcacgaaacagacgaaaaccgcgcaaaagucgaaauaacaccaaacucacccagagccgaggccacacuugggggauucggcagccucgguuuagacugcgaaccaaggaccgggcucgacuucucagaccuguacuaccucacaaugaauaacaaacacuggcucguacacaaagaaugguuccaugacaucccccuacccuggcacgccggcgcagacacaggcacgccacacuggaacaacaaagaagcgcucguggaguucaaagacgcccacgccaaacgccaaaccguaguggugcuagggagccaggaaggagcagugcacacagccuuagccggcgcccuggaagcagaaauggacggagcaaaaggccggcucagcagcggacaccucaaaugccgacugaaaauggacaaacuacgccuaaaaggagugagcuacagccucugcacagccgcguucacauucagcaagauacccgcggaaacacuacacggaacaguaacagaagaaguccaauacgcaggcaccgacggacccugcaaggugcccgcacaaauggccguagacaugcaaacacucacaccgguuggcagacucaucaccgcaaaccccgugauaaccgaaagcacagaaaacucaaaaaugaugcucgaacucgacccgccauucggagacucguacauaguaauaggaguaggcgaaaagaaaaucacgcaccacuggcaccgcagcggaucaacaaucggcaaagccuucgaagcgaccgucagaggagcaaaacgcauggcgguacugggagacacagcaugggacuucggaucg

SEQ ID NO: 2999 - RNA, 1353 nt, Artificial Sequence
  KX087101.3 solE CDS opt
ucccaaaaaguaauauaccuaguaaugauccuccuaauagcacccgcauacagcauccgcugcauaggggucucgaacagggacuucguagaaggcaugagcggaggaacauggguagacguagucuuagaacacggcggcugcgucaccguaauggcccaagacaaaccaaccguagacauagaacuggucaccaccacgguaucgaacauggcagaaguccgaagcuacugcuacgaagccagcaucagcgacauggccucagacagccgaugccccacccaaggcgaagccuaccucgacaaacaaucagacacccaauacguaugcaaacgcacccuaguagaccgaggcuggggcaacggcugcggccuguucggaaaagggagccuggucacaugcgccaaauucgccugcuccaagaaaaugacaggaaaaucaauccaacccgaaaaccuagaauaucgcaucaugcuauccguacacggaucccaacacuccggaaugauaguaaacgacacaggacacgaaaccgacgaaaaccgcgccaaaguagaaauaaccccaaacucucccagagccgaagccacacucggaggauucggcucccuaggccuagacugcgaaccccggaccgggcucgacuucuccgaccucuacuaccucaccaugaacaacaaacacuggcucguccauaaagaaugguuucacgacauaccccucccauggcacgcaggcgcagacaccgguacaccacacuggaacaacaaggaagcgcuaguagaguucaaagacgcccacgccaaacgccaaaccguagucgugcuaggcagccaggaaggagccguacacacagcacuggccggagcucucgaagcagaaauggacggagccaaaggccggcuaucaagcggacaccuaaaaugccgccuaaaaauggacaagcuaagacucaaaggcgugagcuacagccuaugcacagccgcauucacguucaccaaaauaccugcagaaacccuacacggaacaguaacagucgaacuccaauacgcaggcacggacggacccugcaaagugcccgcccaaauggccguggacaugcaaacgcucacacccguaggaaggcucauuacagcaaacccagucaucaccgaaagcacagaaaacucaaaaaugaugcuagaacuugaucccccauucggagacucguacauagucaucggcguaggggagaaaaagaucacacaccacuggcaccgaucaggcucaacaaucggcaaggccuucgaagccaccguccgaggagcaaaacgaauggccguacuaggggacacagccugggacuucggcuca

SEQ ID NO: 3000 - RNA, 1353 nt, Artificial Sequence
  KY003156.1 solE CDS opt
agccaaaaagucauauaccuggucaugauccuccuaauugcaccagccuacagcauacguugcaucggcaucuccaacagagacuuugucgaaggcaugagcggagggacguggguagacgugguacuagaacacggaggcuguguaaccguaauggcccaagacaaaccaaccgucgacaucgagcuagucacuacaacagucagcaacauggcagaaguccgaagcuacugcuacgaagccagcauaagcgauauggcgagcgacagcagaugcccaacccaaggugaagcauaccuagacaaacaaagcgacacccaguacgugugcaaacgcacacugguagaccggggcuggggcaacggcugcggccuguucggcaaaggaucccuagucacaugcgcaaaauucgccugcagcaagaaaaugaccggaaaaucuauccaaccagaaaaccuagaauaucgcauaaugcuaagcguacacggaagccagcacuccggaaugaucguaaacgacaccggacacgaaaccgacgaaaaccgagccaaaguagaaaucacccccaacucgcccagagcagaagcaacccuuggaggcuucggaauccuaggacucgacugcgaacccaggaccggacuagacuucagugaccuguacuaccuaacaaugaacaacaaacacuggcucguccacaaggaaugguuccacgacauaccccucccuuggcacgcaggcgcagacacaggaacgccacacuggaacaacaaggaagcacucgucgaguucaaagacgcccacgccaaacgucaaaccgucguaguccucggcucacaagaaggagccguacacacagcccuggcaggagcccucgaagcagaaauggacggagcaaaaggacgccuaagcagcgggcaccuaaaaugccgccuaaaaauggacaaacuccgacucaaaggcguaagcuacagccuaugcaccgccgcauucaccuucacaaaaauacccgcagaaacccuccacggcaccgucaccgucgaaguccaauacgcaggaaccgacggaccaugcaaaguccccgcacaaauggcaguagacaugcaaacccucacaccaguaggaagacucaucaccgcaaacccagucaucaccgagagcaccgagaacucaaaaaugaugcucgaacucgacccacccuucggcgacucuuauauagucaucgggguaggagaaaagaaaaucacacaccacuggcaccgaucgggcuccaccauaggaaaagccuucgaagcaaccguccgcggagccaaacgcauggcugugcucggagacacggcuugggacuucggauca

SEQ ID NO: 3001 - RNA, 1353 nt, Artificial Sequence
  KU758876.1 solE CDS opt
agccaaaaaguaauauaccucgucaugauacuacuaauagccccggcauacaguaucagaugcaucggggucagcaacagagacuucgucgaaggcaugaguggaggcacguggguagacguaguacuagaacacggaggaugcgucacagucauggcacaagacaaaccgaccguagacauagagcuaguaacaaccaccgucagcaacauggccgaagucagaagcuacugcuacgaagccaguauauccgacauggccagcgacucgaggugccccacccaaggcgaagccuaccuugacaaacaaagcgacacacaauacguaugcaaaagaacccuagucgaccgaggcuggggaaacggaugcggccucuucggaaagggaagccuagucacaugcgccaaauuugcaugcagcaagaaaaugacaggaaaaagcauacaacccgaaaaccuagaauaccgcaucaugcuaagcguccacggaagccagcauagcggcaugauaguaaacgacacagggcacgaaaccgacgaaaaccgagccaaaguagaaaucacaccaaacagccccagagccgaagccacgcucggaggcuucggaagccuaggacucgacugcgaacccagaaccggacucgacuucagugaccucuacuaccuaacaaugaauaacaaacacuggcugguccacaaagaaugguuccacgacaucccacuacccuggcacgcaggagcggacacgggcacaccacacuggaacaacaaagaagcucucguagaauuuaaagacgcccacgcaaaacgccagaccguagucguccuaggaagccaagaaggagccguacacaccgcccuggcaggagcgcuggaagcggaaauggacggaguaaaaggaaggcuaagcagcggccaccucaaaugccgccuaaaaauggacaaacuacgccuaaagggcguaagcuacagccuaugcacagccgcguucacauucacaaagauaccagccgaaacgcuccacgggacagucacaguagaaguccaauacgcaggaacagacggaccaugcaaagugccagcacaaauggccgucgacaugcaaacccuaacccccguaggccggcuaauaacagcaaacccugucauaaccgaaucgacagaaaacuccaagaugaugcuagaacucgaucccccauucggcgacaguuacauugucauaggagugggcgaaaagaaaauaacacaccacuggcaucgaagcggaucaaccaucggcaaagccuucgaagccaccguacgaggagccaaacgcauggcagugcuaggcgacacagcaugggacuucggcagu

SEQ ID NO: 3002 - RNA, 1353 nt, Artificial Sequence
  KU926310.1 solE CDS opt
agccaaaaaguaauauaccuagucaugauccuacucauagccccagcauacagcauacgcugcauaggaguguccaaccgagacuucgucgaaggcaugucaggcggcacguggguagacguaguacuagaacacggcgggugcguaacagugauggcccaagacaaacccacagucgacaucgagcucgucacaaccacagucuccaacauggccgaagucagaucauauugcuacgaagcaagcaucuccgacauggcaagcgacagcagaugcccaacccaaggagaagccuaccuugacaaacaaucagacacccaauacgucugcaaacgcacccuagucgaccggggauggggcaacggaugcgggcuauucggaaaaggaucccuaguuacaugugccaaauucgcaugcucaaagaaaaugaccgggaaaucaauacaacccgaaaaccuagaauaccgcaucaugcugagcguacacggcagccaacauucaggcaugaucguaaacgacaccggacacgaaacagaugaaaaccgcgccaaaguggaaauaacuccaaacucccccagagccgaagccacacucggaggcuucggcucgcucggacucgacugcgaacccagaacaggccuugacuucucagaccuauauuaccuuacaaugaacaacaaacacuggcucguacacaaagaaugguuccacgauauaccccuacccuggcacgcaggcgcagacaccggcacaccccacuggaacaacaaagaagcccuaguagaguucaaagacgcacacgcaaaacgccaaaccgucguaguccucggaucacaagaaggcgccguacacacggcccuugccggcgcacuagaagcagagauggacggcgccaaaggccgacuaucaagcgggcaccugaaaugcagacucaaaauggacaaacuccgacuaaagggcguguccuacucacuaugcacagcagcauucacauucacaaagauacccgcagaaacccuacacggaacgguaacagucgaaguacaauacgccggcgcagauggaccaugcaaaguacccgcgcaaauggccguagacaugcaaacacucacgcccgucggacgacucauaacugcgaaccccgucauaacagaaagcacagaaaacuccaaaaugaugcuagaacucgaucccccauucggcgacuccuauauagucaucggcgucggagagaagaaaauaacacaccacuggcaccgcuccggcuccacuaucggcaaagccuucgaagccaccguacgaggagccaaacgaauggccguccucggagacaccgcaugggacuuuggauca

SEQ ID NO: 3003 - RNA, 1353 nt, Artificial Sequence
  KU681081.3 solE CDS opt
ucccagaaagucaucuaccugguaaugauccuacuaauagcccccgcauacagcauaagaugcaucggaguauccaacagagacuucgucgaaggaauguccggcggcacauggguagacguagucuuggaacacggaggcugcguaaccgucauggcacaagacaaacccaccgucgacaucgaacucgucacgaccacagucucgaauauggccgaagucagaagcuacugcuacgaagcaagcauaagcgacauggccagcgacagcagaugcccaacccaaggcgaagccuacuuagacaaacaguccgacacccaauacguaugcaaacgcacccucguagaccgaggcuggggaaacggcugcggccuguucggaaaaggaagccucguaaccugcgcgaaauucgccugcuccaagaaaaugaccggaaaaucaauccagccugaaaaccucgaauaccgcauaaugcucagcguccacggaagccagcauagcggcaugaucguaaaugacacaggacacgaaaccgacgaaaaccgcgcaaaaguagaaauaacaccgaacucccccagggccgaggccacacucggcggcuucggcucgcucggccucgacugcgaaccaaggaccggacuagacuucagcgaccuauacuaccucacaaugaacaacaaacacuggcuaguacacaaagaaugguuccacgacauaccccucccauggcacacaggcgccgacaccggcacaccccacuggaacaacaaagaagcccuaguagaguucaaagacgcccaugccaaacgccaaaccguggucguccucggaucacaggaaggcgccguucacaccgcucuagcaggagcccuagaagccgaaauggacggagccaagggacgacucucaagcggacaccucaaaugcagacucaaaauggacaagcuacgacuaaaaggaguaagcuauagccugugcaccgcagcauucaccuucaccaaaauacccgcagaaacacuccacggcacgguaaccgucgaaguacaauacgcaggcaccgacggcccaugcaaaguacccgcccaaauggccgucgacaugcaaacacuaacccccguaggccgacucauaacagcaaacccagucauaaccgaaggcaccgaaaauagcaagaugaugcucgaacuggacccgcccuucggcgacucguacauagucauaggagugggcgagaaaaagaucacacaccacuggcaccgcuccggcucaaccauaggcaaagccuucgaagccaccguccgaggggccaaacgcauggccgugcucggagacacagccugggacuucggcuca

SEQ ID NO: 3004 - RNA, 1353 nt, Artificial Sequence
  KU744693.1 solE CDS opt
ucgcaaaaaguaauauaccucgucaugauccuccucauagcccccgccuacuccauacgcugcauaggcgucuccaaccgggacuucgucgaaggaaugagugggggcaccugggucgacguaguccuagaacacggcggaugcguaaccgcaauggcccaggacaagcccaccgucgacauagaacucguaacgacaacagucuccaacauggccgaagucagauccuacugcuacgaagcaagcaucucagacauggcaagcgacagccgaugcccaacccaaggcgaagccuaccuagacaaacaaagcgacacccaauacguaugcaaacgaacccuagucgaccgcggcuggggcaacgggugcggccuauuugggaagggaagccucgucacaugcgcaaaauuugcaugcagcaaaaagaugaccgggaaaagcauccaaccagaaaaucucgaauaccgcauaaugcuauccguccacggcagccaacacagcggcaugcuaguaaacgacaccggacacgaaaccgacgaaaaccgcgcaaaaguagaaauaacaccaaacuccccacgagcagaagcaacacucggcggcuucggaagccuaggccuagacugcgaacccagaaccggacucgacuucagcgaccucuacuaccucacaaugaacaacaaacacuggcuagcccacaaggaaugguuccacgacaucccacuacccuggcacgcaggcgcagcaacgggaacaccacacuggaacaacaaagaagcccuaguagaguucaaagacgcacaugcuaaacgacaaaccgucguaguacuaggaagccaagaaggcgcaguccacaccgcccucgccggagcacuagaagccgaaauggacggagccaaggggagacuuucaagcggccaccuaaaaugucgccuaaaaauggacaaacuacgccucaaaggcgucagcuacagccucugcacagccgcauucacauucaccaaaauaccugcugaaacagucgacggaacaguaacagucgaaggacaauacggaggaacugacggccccugcaagguaccagcacaaauggccgucgacaugcagacgcuaacgccaguaggacgacucauaaccgccaacccagucauaaccgaauccacagaaaacagcaaaaugaugcucgaacuagacccacccuucggggacuccuacauagucauaggagucggcgaaaagaaaaucacccaccacuggcaccgcagcggcucaaccauaggcaaagcauucgaagcgacaguacgcggagcaaaacgcauggccguacuaggagacacagccugggacuucggaucc

SEQ ID NO: 3005 - RNA, 1353 nt, Artificial Sequence
  EU545988.1 solE CDS opt
ucccaaaaggugauauaccuagucaugauccuccuaauagccccagccuacagcauacggugcaucggagucuccaacagagacuucgucgaaggcaugagcggaggaacauggguagacguaguccuagaacacggcggaugcguaacagugauggcgcaagacaaaccagccguagacauagaacuggucacaacaacggucagcaacauggcagaagucagaagcuacugcuacgaagcaagcauaagcgacauggcgagcgacagcagaugcccaacccagggcgaagcauaucucgacaaacaaucagacacacaguacguaugcaagagaacgcucguagaccgaggcuggggcaacggaugcggccuguucggaaaggggagccucgucacgugcgcgaaauucgcgugcagcaagaaaaugaccgggaaaucaauacagccagagaaccuggaauaccgaauaaugcucagcguccacggcagccaacacagcggcaugaucgucaacgacacaggacaugaaaccgacgaaaaucgcgcaaaagucgaaaucacaccgaacucgcccagagccgaagccacacucgggggauucgguagccuaggacucgacugcgagcccaggacaggacucgacuucucggaccuguacuaccuaacaaugaacaacaaacacuggcucgugcacaaagaaugguuccacgacauaccccuacccuggcacgcaggcgcagacacaggcacaccccacuggaacaacaaagaagcccuaguggaguucaaagacgcacaugcaaaacgacaaaccguaguagugcuaggaagccaggaaggagccguacacacagcccuggccggagcauuggaagccgaaauggacggagcaaaaggcaggcucuccagcgggcaccugaaaugccgccugaaaauggacaaacuacgacucaaaggcguguccuacagucucugcaccgcagcguucacauucacaaaaauacccgcagaaacgcuccacggcacggucacggucgaaguccaauacgcuggaaccgacggacccugcaaaguaccagcgcaaauggccguggacaugcagacgcucacaccagugggacggcucauaacagcgaacccagucauaacagaaagcacagaaaacaguaaaaugaugcucgaacuagacccgcccuucggggacuccuacauaguaaucggcguaggcgaaaagaaaauaacgcaccacuggcaccgcuccggcaguaccauaggaaaagcauucgaagcgacaguacgaggagccaagcgcauggcgguacugggagacacagccugggacuucggcucc

SEQ ID NO: 3006 - RNA, 1353 nt, Artificial Sequence
  KY007221.1 solE CDS opt
agccaaaaagucaucuaccuuguaaugauccuccuaauagccccagcguacagcauccgcugcaucggcguaaacaacagggacuucguagaaggcauguccggaggcaccuggguagacgucguacucgaacacgguggaugcguaaccguaauggcccaagacaaaccaaccguagacaucgagcuagucacgaccacaguaagcaacauggcagaagucaggagcuacugcuacgaagcaagcaucagcgacauggcaagcgacagccgcugcccaacccaaggagaagcguaccucgacaaacaaagcgacacacaauacgucugcaaaagaacccucguggaccgaggcuggggcaacggcuguggccuauucggcaaagggagccuagucacaugcgccaaauucgcaugcagcaagaaaaugaccggaaaaagcauccaacccgaaaaccuagaauaccgaauaaugcugagcguccacggaagccaacacucaggcaugaucgucaacgacaccggccacgaaacagacgaaaacagagcaaaaguagaaaucaccccaaacagccccagagccgaagcaacacuaggcggcuucggaagccugggacuggacugcgagccccgaaccggacuagacuucucagaccuauacuaccucacaaugaauaacaaacacuggcuaguacacaaagaaugguuccacgacauaccacugccauggcacgccggcgcggacaccggaacaccccacuggaacaacaaagaagcacucguagaguucaaagacgcccacgccaaacgccaaaccgucguaguacuaggcagccaagaaggagccguacacacagcccuggccggagcacucgaagccgaaauggacggggccaaaggccgacucuccagcgggcaccucaaaugccgccucaaaauggacaaacuacgacucaaaggcguaagcuacagccucugcacagccgcauucacauucaccaaaauacccgccgaaacccuacacgguacagugacagucgaaguacaauacgcaggcacggacgggcccugcaaaguacccgcacagauggccguagacaugcaaacacuaacaccagucggcagacucaucacagccaaccccguuaucaccgaaagcacagaaaacagcaaaaugaugcucgaacuagacccaccauuuggcgacagcuacauagucauuggagucggagaaaagaaaaucacacaccacuggcacagauccggcagcacaaucggaaaagccuucgaagcaaccguccgaggcgcgaaacgaauggcaguacuaggagacacagcaugggacuucgguagc

SEQ ID NO: 3007 - RNA, 1353 nt, Artificial Sequence
  KY003152.1 solE CDS opt
ucccaaaaaguaauauaccuaguaaugauauuacucauagcaccggccuacagcauccgcuguauagggguauccaacagagacuucgucgagggcaugagcggcggcacaugggucgacgucguacuagagcacggcggcugcguaacagucauggcacaagacaaaccaaccguggacaucgagcuagucaccaccacagucucaaacauggccgaagucagaagcuacugcuacgaagcgagcaucagcgacauggcaagcgacagcagaugcccaacccaaggcgaggcuuaccucgacaagcagagcgacacccaauacgugugcaaacgcacgcuaguagacagaggcuggggaaauggaugcggacuuuucggaaaaggaagccuaguuacgugcgcaaaauucgccugcagcaagaaaaugaccgggaaaucaauccaacccgaaaaccuagaauaccgaauaaugcuaagcguacacggcagccaacacucgggaaugauaguaaacgacacaggacacgagacagacgaaaacagagccaaaguagaaauaacaccgaacucacccagggccgaggcaacacucggaggcuucggcucgcuagggcucgacugcgagcccagaaccggccuagacuucuccgaccuauacuaccucacaaugaauaacaaacacuggcuaguacacaaggaaugguuccacgacauaccacugcccuggcacgcaggcgcagacacaggaacaccccacuggaacaacaaggaagcccuagucgaguucaaagacgcacacgcaaagcgacaaaccguagucguccuuggaagccaagaaggagccguacacacagcccucgcaggggcccuggaagcagaaauggacggagccaaaggcagacuauccagcggacaccugaagugccgacucaaaauggacaagcucaggcucaagggagucuccuacagccuaugcgcagccgccuucacauucacaaaaauacccgcggaaacgcuccacggcacaguaacggucgaaguccaguacgcaggcacagacggacccuguaaaguacccgcgcaaauggcagucgacaugcaaacacuaacaccagucggcaggcucauaaccgccaacccggucauaaccgagaguacagaaaacagcaaaaugaugcucgaacucgaucccccauucggagacagcuacauaguaauaggaguaggcgaaaagaaaaucacccaccacuggcacagaucaggcucaacaauaggcaaagcauucgaagcaaccguacgcggagcaaaacgaauggccguccuaggggacaccgccugggacuuugguuca

SEQ ID NO: 3008 - RNA, 1353 nt, Artificial Sequence
  KX694533.2 solE CDS opt
ucacaaaaaguaaucuaccucguaaugauccuacuaaucgcacccgccuacagcauacgaugcaucggaguaucaaaccgcgacuucgucgaagguauguccggcggaacauggguagacgucgucuuagaacacggagggugcguaacagucauggcccaagacaaaccaacaguagacauagagcucguaacaaccaccguaagcaacauggcagaaguccgcagcuacugcuacgaggccagcauaucagacauggccuccgacucacgaugcccaacacaaggagaagcauaccuagacaaacaaagcgacacccaauacgucugcaaaagaacacuggucgacagaggauggggcaacggaugcggccuauucggaaaaggcagccuaguaaccugcgcaaaauucgccugcagcaagaaaaugaccggcaaauccauacaaccagaaaaucuagaauaccgaauaaugcuauccguccacggaagccaacacuccggcaugaucgucaacgacaucggccacgaaaccgacgaaaaccgagccaaagucgaaaucacccccaacucaccccgagcagaagccacacucggcggcuucggaucccucggacuagacugcgaacccagaacaggccucgacuucagcgaccucuacuaccuaacaaugaacaacaaacacuggcucguccacaaagaaugguuccacgacauaccacugcccuggcacgcaggcgccgacacaggcacgccccacuggaacaacaaagaggcacucguggaguucaaagacgcccacgccaaaagacaaacaguaguaguacucggcagccaagaaggagccguccacacagcccucgcaggagcccucgaagccgaaauggacggagccaaaggcagacucuccagcgggcaccugaaaugccgccucaaaauggacaaacuacgccucaaaggcgucagcuacagccucugcacagcagccuucaccuucaccaaaauccccgccgaaacacuccacggaaccguaacaguagaaguccaauacgccggcacagacggacccugcaaaguacccgcacaaauggccgucgacaugcagacccucacgcccguaggaagacucaucaccgcaaaccccgucauaaccgaaagcacagaaaacagcaagaugaugcuagaacucgacccacccuucggagacagcuacaucguaauaggagugggagacaagaaaaucacacaucacuggcaccgcagcggcucaacaauaggcaaagcauuugaagccacaguacgcggggccaaaagaauggccguccuaggggacaccgccugggacuucggaucc

SEQ ID NO: 3009 - RNA, 1353 nt, Artificial Sequence
  KX601167.1 solE CDS opt
agucaaaaagucauauaccucgucaugauccugcuaaucgcccccgccuacagcauacgcuguaucggagugagcaacagggacuucguagaaggaaugaguggaggcaccugggucgacguaguacuagaacacggaggaugcguaaccguaauggcacaagacaaaccaaccguagacaucgagcuagucacaaccacagucucaaacauggccgaagucagaagcuacugcuacgaagcaagcaucagcgacauggcaagcgacagccgaugcccaacacaaggagaagcauaccuagacaaacaaagcgacacccaauacgugugcaaacgcacccuagucgaccgaggauggggcaauggaugcggccucuucggaaaaggaucccuagucacaugcgcgaaauucgcaugcagcaagaaaaugacuggaaaaucaauccagccagaaaaccuagaauaccgaaucaugcucucgguacacggcagucaacacagcgguaugauagugaacgacaccggacacgaaaccgaugaaaacagagccaaagucgaaauaaccccaaacucccccagagccgaagccacacuaggaggcuucggaucgcuaggacuugacugcgaaccaagaaccggacuagacuucuccgaccuauacuaucuaacaaugaacaacaaacacuggcucgugcacaaagaaugguuccacgauauaccacugccauggcacgcaggagcggacacaggaacaccccacuggaacaacaaagaagcccuaguagaguucaaagacgcccacgccaaacgacaaaccgucgucguacuaggcagccaggaaggagccguacacacagcccucgcgggcgcccuagaagccgaaauggacggagcaaaaggcagacuaucgucaggccaccucaaaugccgccugaaaauggacaaacuaaggcucaaaggagugucauacagccucugcacagccgcguucacauucacaaaaauaccagcagaaacacuccacggaacaguaacaguagaaguccaauacgcaggaacagacggacccugcaaaguccccgcccaaauggccguagacaugcaaacccucacgccagucggcagacugauaaccgcaaacccaguaaucacagaaagcacagaaaacucaaaaaugaugcucgaacuagacccaccauucggcgacagcuauauaguaauaggcgucggagacaagaaaaucacacaccacugguaccgcucaggcuccaccaucggaaaagccuucgaagccaccguacgaggagcaaaacgcauggcagugcuaggggacacggccugggacuucggaagc

SEQ ID NO: 3010 - RNA, 1353 nt, Artificial Sequence
  KY288905.1 solE CDS opt
agccaaaaaguaauauaccuaguaaugauccuacuaauagcccccgcauacagcauccgcugcauagggguauccaacagggacuucgucgaaggcaugagcggaggcacaugggucgacgugguccuagagcacggaggcugcguaaccguaauggcacaagacaaaccaaccgucgacaucgaacuggucaccaccacaguuagcaacauggccgaagucagaagcuacugcuacgaagcaagcaucucagacauggcaagcgacucccggugccccacacaaggagaagcauaccuagacaaacagagcgacacccaauacguaugcaaacgcacacucgucgaccgaggcuggggcaacggcugcggacuauucggaaaaggaagccucgucacaugcgcaaaauucacaugcagcaaaaaaaugacaggaaagagcauccaaccagaaaaccuagaauaccgcauaaugcuaagcguacacgguagccaacacucaggcaugauagucaacgacaccggccacgaaaccgacgaaaaccgagccaaaguagaggucacccccaacagcccacgagccgaagcaacccuaggcggcuucggcagcuuaggccucgacugcgaaccccgcaccgggcuagacuucagcgaccuauacuaccuaaccaugaacaacaaacacuggcucgugcacaaagaaugguuccacgacauacccuuaccauggcacgccggcgcggacacaggcacaccccacuggaacaacaaagaagcccucgucgaauucaaagacgcucacgccaaacgccaaacaguaguaguacuaggcagccaggaaggcgcgguacacaccgcccuagccggagcccuagaagccgaaauggacggggccaaaggccgacucuucagcggacaccugaaaugccggcugaaaauggacaaacucagacuaaaaggcgucagcuacagccuaugcacagcagccuucacauuuacaaaaguacccgcagaaacacuccacggcaccgucacagucgaaguacaauacgcaggcacagacggcccaugcaaaguaccagcacaaauggccguagacaugcaaacacucacaccagugggcagacucaucaccgccaacccaguaauaaccgaaagcaccgaaaacuccaaaaugaugcuagaacucgacccaccauucggcgacuccuacauaguaauaggcgucggcgacaaaaaaaucacacaccacuggcaucgaagcggcuccacaaucggcaaagcauucgaagcaaccguaagaggagccaaacgaauggcuguacucggcgacaccgcaugggacuucggcuca

SEQ ID NO: 3011 - RNA, 1353 nt, Artificial Sequence
  KF268950.1 solE CDS opt
ucgcaaaaagucaucuaccuaguaaugauccuccucauagccccagcuuacagcaucagauguaucggaguauccaacagagacuucgucgaaggcaugagcgggggcacaugggucgacguaguccuagagcacggcgggugugucacuguaauggcgcaagacaaaccaacaguagacauagagcuaguaacaaccaccgucucaaacauggccgaaguccgaagcuacugcuaugaagccagcauaagcgacauggcaagcgacagcagaugcccgacacaaggcgaagccuaccuagacaaacaaagcgacacccaauacguaugcaaacgcacccuaguagaccggggauggggaaacggcugcggccuauucgggaaaggaagccuaguaacaugcgccaaauucacaugcagcaagaaaaugaccgggaaaucaauccaacccgaaaaccuagaauaccgcauaaugcugagcgugcacggaagccaacacucaggcaugauaguaaacgacaucggccacgaaacagacgaaaaccgagcgaaaguagaagugacaccgaacucacccagggcagaagccacgcucggaggcuucgguucguuaggacuagacugcgagcccagaacaggacucgacuuuucggaccuguacuaccuaaccaugaacaacaaacacuggcugguacacaaagaaugguuccacgacauaccccugccauggcacgcaggagcagacacuggcacaccccacuggaacaacaaagaagcacucguggaguucaaagacgcccacgccaaacgacaaaccgucgucgugcucggaagucaagaaggagcagugcacaccgcccucgccggagcacuagaagcggaaauggacggggccaaaggccgccucuucagcggacaccucaaaugcaggcugaaaauggacaaacuaagacucaagggaguaagcuacagccucugcaccgcugcauucaccuucacgaaaguacccgcggaaacgcuacacggaacaguuacggucgaaguccaguacgcaggcacggacgggcccugcaaagugcccgcacagauggccguugacaugcaaacacucaccccagucggcagacucauaacugcaaacccggucaucaccgaaaguacggaaaacagcaagaugaugcuagagcuagaucccccauucggggacuccuacauagucaucggcgugggcgacaagaaaaucacgcaccacuggcaccgaucgggcucgaccaucggcaaagccuuugaagcaaccgugcgaggagccaaacgcauggccguccucggcgacacagccugggacuucggcucc

SEQ ID NO: 3012 - RNA, 1353 nt, Artificial Sequence
  KF383116.1 solE CDS opt
ucccaaaaaguaauauaccucgucaugauacuccucauagcccccgcauacagcauacgcugcaucggggucuccaacagagacuucgucgaaggaaugagcggaggcacauggguggacguaguccuggaacacggaggaugcguaaccguaauggcccaagacaaaccaaccgucgacauagagcuaguuacaaccaccgucuccaacauggccgaaguccgcuccuacugcuacgaagccagcauaagcgacauggccagcgacagcagaugcccgacccaaggcgaagccuaccuagacaaacaaagugacacccaauacgucugcaaacgaacacucguagaucgcggcuggggcaacggcugcggucuguucggaaaaggaagccuaguaaccugcgccaaauucacaugcagcaagaaaaugaccggaaaaucaauccagcccgaaaaccucgaauaccgcauaaugcuauccguacacgguagccaacacuccggcaugaucgucaacgacaucggacacgagacagacgaaaaccgcgccaaaguagaaguaaccccaaacucccccagggccgaagcaacacucggaggcuucggaucccuaggacuagacugcgaacccagaaccggccucgauuucagcgaccuauacuaccucacgaugaacaacaaacacuggcucguacacaaagaaugguuccacgacauaccccuacccuggcacgccggcgcagacaccggcacaccccacuggaacaacaaagaagcacucguagaguucaaagacgcacacgcaaaacgccaaaccguaguaguccuaggcagccaagaaggcgccguacacaccgcccuggccggagcgcuagaagcagaaauggacggagccaaaggcagacuauucagcggccaccuaaaaugccgacuaaaaauggacaaacucagacucaaaggaguaagcuacagccuaugcaccgccguaugcaccgccgccaaaguccccgcagaaacacuacacggcacagucacaguagaaguccaauacgcaggcacggacggccccugcaaagugccagcccaaauggccguagacaugcaaacucugacaccagucggcagacucauaaccgccaacccaguaauaacagaaagcacggaaaacucaaaaaugaugcuugaacucgacccgcccuucggagacucauacauagucauaggaguaggcgacaagaaaaucacacaccacuggcaccggagcggcuccacuauaggcaaagcauucgaagcaaccguaagaggagccaaacgaauggccguacuaggggacacagcaugggacuucggcucc

SEQ ID NO: 3013 - RNA, 1335 nt, Artificial Sequence
  KU963574.2 solE CDS opt
ucgcaaaaagucauauaccuggucaugauccugcuuaucgcacccgcuuacuccauccgcugcaucggagucucgaacagggacuucgucgaaggcaugagcggaggcacauggguagacguaguccuagaacacggcggcugcgugaccgucauggcacaagacaaaccgacaguagacauagaacucgucacaaccacagucucgaacauggcagaaguuagaaguuacugcuacgaagccagcauaagcgacauggcaagcgacagcagaugcccaacccaaggggaagcauaccuggacaaacaaagcgacacccaauacgucugcaaacgcacgcuaguagacaggggauggggcaacggaugcggacuguucgggaaaggaagccuagucacaugcgcgaaguucacaugcagcaagaaaaugacaggaaaauccauacaacccgaaaaccuagaauaccgaauaaugcugagcgugcacggaagccaacacagcggcaugauaguaaacgacgaaaaccgcgcgaaaguagaaguaaccccaaacagcccaagggccgaggcaacgcuaggaggauucggaagccuagggcucgacugcgagcccagaaccggacucgacuucucggaccuauacuaccuaacgaugaacaacaaacacuggcuaguacacaaagaaugguuccacgacauaccgcuccccuggcacucgggagcagacaccgaaacgccacacuggaacaacaaagaagcgcuaguagaguucaaagacgcccacgccaagcgacagacaguagucguacucgggagccaggaaggagccguacacacagcccucgccggagcccucgaagcagagauggacggagccaaaggccgacuaucguccggccaccuaaaaugccgccugaaaauggacaaacucaggcuaaaaggcgugagcuacagccugugcaccgccgcauucacauucacaaaagugcccgcagaaacacuccauggaacagucacagucgaaguccaauacgcaggaagggacgggcccugcaaaguacccgcgcagauggcaguagacaugcaaacgcuaacccccgucggcagacucauaacagcgaacccggucauaaccgaaagcacagaaaacagcaaaaugaugcuagaauuagaucccccauucggggacucauacaucgucauaggcguaggcgacaagaaaauaacacaccacuggcacagaucaggcuccauaauaggcaaagccuucgaagcaacagugcgaggagccaaacgcauggcaguacuaggagacaccgccugggacuucggcuca

SEQ ID NO: 3014 - RNA, 1353 nt, Artificial Sequence
  KF383118.1 solE CDS opt
ucacaaaagguaauauaccuagucaugaucguacucauagucccggcauacagcauaagcuguaucggaguaucaaaccgagaccugguagagggcaugagcgggggcacauggguggacgugguacuggaacauggcggaugcguaaccgaaauggcgcaagacaaaccgaccguggacauagagcuaguaacaaugaccgucucgaacauggcagaagucagaagcuacugcuacgaagcaagccugagcgacauggcaagcgcaaguaggugcccgacccaaggagaaccaucacuagacaaacaaagcgacacccagagcguaugcaagagaacgcuaggggacagaggcuggggaaacggcugcggaaucuucggaaaaggaucccuagucacgugcuccaaauuuacaugcugcaagaaaaugccagggaaaagcauccagccagagaaccucgaauauagaauaaugcuacccgugcacggcagccagcacucaggaaugaucgugaacgacaucggacacgagaccgacgaaaaccgcgcaaaaguggaaguaaccccaaacucacccagagcagaagccacgcucggaggauucggaagccucgggcucgacugcgaaccccgaaccgggcucgacuucucagacuuauacuaccuaacaaugaacaacaagcacuggcucguacacaaagagugguuccacgacauaccccugccauggcacgcgggagcagacacaggcacgccgcauuggaacaacaaggaggcacucguagaguucaaagacgcgcacgcaaagcgacaaacagucguagugcucggaagccaagaaggggccguccacacagccuuagccggggcccucgaagcagaaauggacggggcaaagggccggcucuuuagcggccaccuaaaaugccgccuaaaaauggacaagcuaagacuaaagggcguaagcuacagccugugcacagccgcauucacauucacaaaaguacccgcagaaacgcuccacggcacagucacagucgagguccagagcgcgggaacggacggacccugcaaaguaccagcgcaaauggccguagacaugcaaacacucacccccgugggaaggcuaauaacagcaaacccgguaauaaccgaaagcacagaaaacagcaagaugaugcucgaguuagacccaccauucggggacucauacauaguuauaggcguaggcgacaagaaaaucacgcaccauuggcacagauccggaaguaccaucggcaaagccuucgaagcaaccgugcgcggggccaagagaauggcagugcucggagauaccgcaugggacuucggcuca

SEQ ID NO: 3015 - RNA, 1353 nt, Artificial Sequence
  KX520666.1 solE CDS opt
cgacaaaaagucauuuaccuaguaaugauacuccuaauagccccagccuacagcauuagaugcaucgggguaucaaacagggacuucguagaaggaaugagcggcggaaccuggguagacgucguccucgaacacggcggcugcguaaccguaauggcacaagacaaaccgaccguagacauagaacucgucaccaccacagucucaaacauggcagaaguccggagcuacugcuacgaggcuucuauaagcgacauggcaagcgacagcagaugcccaacccaaggcgaagcauaccuagacaaacaaagcgacacccaguacguaugcaaaagaacccucguagaccgaggauggggcaacggcugcggccuguucggaaaaggaagccugguaacaugcgcaaaauuugccugcagcaaaaagaugacagggaaauccauccaacccgaaaaccuagaauacagaauaaugcucagcguacauggaagccaacauagcggcaugaucgucaacgacacaggacacgagacagacgaaaaccgcgcaaaaguagaaaucaccccaaacucacccagggccgaggcaacacucggcggauucggcagccucggccucgacugcgaacccagaaccggccucgacuucucagaccuguacuaucuaaccaugaacaacaaacacuggcucguccacaaagaaugguuccacgacaucccacugcccuggcacgccggcgccgacacaggaacaccacacuggaacaacaaagaagcccuagucgaguucaaagacgcacacgcaaaacgacaaacagucgucguccucggcagccaagaaggagcaguccacacggcccuggcaggagcccucgaagcagaaauggacggagccaaaggcaggcucucaucaggacaccuaaaaugccgccuuaaaauggacaaacuccgacugaaaggaguauccuacagccucugcacagccgcauucaccuucacaaaaauaccagcggaaacacugcacggcacagucaccgucgaaguccaguacgcaggcaccgacggccccugcaaaguaccagcacaaauggcgguggacaugcaaacccuaaccccaguaggccgacuaauaaccgcgaacccagucauaaccgagagcaccgaaaacaguaaaaugaugcucgagcucgacccaccauucggagacagcuacauaguaauaggcgucggugaaaagaaaaucacacaccacuggcaccgcucgggcucaaccaucggcaaagccuucgaagcaacuguacgcggagccaaacgcauggcaguacuaggagacacagcaugggacuucggcuca

SEQ ID NO: 3016 - RNA, 1353 nt, Artificial Sequence
  KF383120.1 solE CDS opt
agccaaagagucaucuaccugguaaugauccuacuaauagccccagccuacagcauccgaugcaucggggucucgaacagagacuucgucgaaggcaugagcggaggcacauggguagacguagugcuggaacacggcggaugcguaaccguaauggcacaagacaaaccaaccguagacauagagcuagucacaacaacagucucaaacauggccgaagucaggaguuacugcuacgaagcaagcauaagcgacauggccagcgacagccgaugcccaacccaaggcgaagcauaccuagacaaacaaagcgacacccaauacgugugcaaacgcacgcuagucgacagaggauggggcaacgggugcggccucuucgggaaaggaagccuagucacgugcgcaaaauucacaugcagcaagaagaugaccggaaaaucaauccaacccgaaaaccuagaauaccgcauaaugcugagcguccacggaagccaacacucaggcaugaucgucaacgacaucggacacgagaccgacgaaaaccgagcgaaaguggaaguaaccccaaacucaccaagggccgaggccacccucggaggcuucggaucgcucgggcuagacugcgaacccagaaccggacucgacuucucagaccucuacuaccucacgaugaacaacaaacauuggcucgugcacaaagaaugguuccacgauaucccacugcccuggcacgcaggcgcggacacaggaacaccccacuggaacaauaaggaagcacuuguagaguucaaagacgcccacgccaaacgccagaccguagucguacuaggaagccaagaaggagccgugcacaccgcccuggcaggagcacuggaagcagaaauggacggagccaaaggccgacucuucagcggacacuugaaaugccgcauaaaaauggacaaacucaggcucaaaggcgugagcuacagccuaugcacugccgcauucacauucuccaagguaccagcagaaacacuccacggcaccgucacgguagaaguccaauacgcaggccgagacgggccaugcaaagugcccgcacaaauggccguagacaugcaaacgcucacacccguaggcaggcucauaacagcgaacccaaucauaacagaaaguacagaaaacagcagaaugaugcuagaacucgacccaccguucggggacuccuacauagucaucggcgugggcgacaagaaaauaacacaccacuggcauagaucgggcucaaccauaggcaaagccuucgaagcgacagugcgaggagcaaaaagaauggccguacuaggagacacagcaugggauuucggcucg

SEQ ID NO: 3017 - RNA, 2359 nt, Artificial Sequence; identical to SEQ ID NO: 235
  R4803/R4833 ZIKV (strain ZikaSPH2015) Polyprotein(93-804) mRNA Design 1 wild type

SEQ ID NO: 3018 - RNA, 2359 nt, Artificial Sequence; identical to SEQ ID NO: 239
  R4815/R4837 ZIKV (isolate Z1106033) Polyprotein(93-804) mRNA Design 1 wild type

SEQ ID NO: 3019 - RNA, 2347 nt, Artificial Sequence; identical to SEQ ID NO: 243
  R4819/R4841 ZIKV (strain MR 766) Polyprotein(93-800) mRNA Design 1 wild type

SEQ ID NO: 3020 - RNA, 2359 nt, Artificial Sequence
  R4867 ZIKV (strain NatalRGN) Polyprotein(93-804) mRNA Design 1 wild type
gggagaaagcuuaccaugagaauaaucaaugcuaggaaggagaagaagagacgaggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3021 - RNA, 2284 nt, Artificial Sequence
  R4879/R5080 ZIKV (strain ZikaSPH2015) Polyprotein(108-794) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3022 - RNA, 2284 nt, Artificial Sequence
  ZIKV (isolate Z1106033) Polyprotein(108-794) mRNA Design 1 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3023 - RNA, 2272 nt, Artificial Sequence
  ZIKV (strain MR 766) Polyprotein(108-790) mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3024 - RNA, 2284 nt, Artificial Sequence
  R4869/R5114 ZIKV (strain NatalRGN) Polyprotein(108-794) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3025 - RNA, 1576 nt, Artificial Sequence; identical to SEQ ID NO: 236
  ZIKV (strain ZikaSPH2015) Polyprotein(273-723) mRNA Design 1 wild type

SEQ ID NO: 3026 - RNA, 1576 nt, Artificial Sequence; identical to SEQ ID NO: 240
  ZIKV (isolate Z1106033) Polyprotein(273-723) mRNA Design 1 wild type

SEQ ID NO: 3027 - RNA, 1564 nt, Artificial Sequence; identical to SEQ ID NO: 245
  ZIKV (strain MR 766) Polyprotein(273-719) mRNA Design 1 wild type

SEQ ID NO: 3028 - RNA, 1576 nt, Artificial Sequence
  ZIKV (strain NatalRGN) Polyprotein(273-723) mRNA Design 1 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3029 - RNA, 2284 nt, Artificial Sequence
  ZIKV (strain ZikaSPH2015) Polyprotein(108-794)(F398S) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3030 - RNA, 2284 nt, Artificial Sequence
  ZIKV (isolate Z1106033) Polyprotein(108-794)(F398S) mRNA Design 1 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3031 - RNA, 2272 nt, Artificial Sequence
  ZIKV (strain MR 766) Polyprotein(108-790)(F398S) mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuccggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3032 - RNA, 2284 nt, Artificial Sequence
  ZIKV (strain NatalRGN) Polyprotein(108-794)(F398S) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3033 - RNA, 2284 nt, Artificial Sequence
  ZIKV (strain ZikaSPH2015) Polyprotein(108-794)(N444Q) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3034 - RNA, 2284 nt, Artificial Sequence
  ZIKV (isolate Z1106033) Polyprotein(108-794)(N444Q) mRNA Design 1 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3035 - RNA, 2284 nt, Artificial Sequence
  ZIKV (strain NatalRGN) Polyprotein(108-794)(N444Q) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3036 - RNA, 2284 nt, Artificial Sequence
  ZIKV (strain ZikaSPH2015) Polyprotein(108-694)-Cterm-JAEV1-E(400-500) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3037 - RNA, 2284 nt, Artificial Sequence
  ZIKV (isolate Z1106033) Polyprotein(108-694)-Cterm-JAEV1-E(400-500) mRNA Design 1 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3038 - RNA, 2272 nt, Artificial Sequence
  ZIKV (strain MR 766) Polyprotein(108-690)-Cterm-JAEV1-E(400-500) mRNA Design 1 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3039 - RNA, 2284 nt, Artificial Sequence
  ZIKV (strain NatalRGN) Polyprotein(108-694)-Cterm-JAEV1-E(400-500) mRNA Design 1 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3040 - RNA, 2359 nt, Artificial Sequence; identical to SEQ ID NO: 235
  ZIKV (strain ZikaSPH2015) Polyprotein(93-804) mRNA Design 1 wild type
